United States Patent 10,793,632 (BISPECIFIC IMMUNOMODULATORY ANTIBODIES THAT BIND COSTIMULATORY AND CHECKPOINT RECEPTORS) - sequence listing, part 3

SEQ ID NO: 28613 - protein, 252 aa, Artificial Sequence
  Description of Artificial Sequence: Synthetic polypeptide
  XENPA57 (XENP022768 [ICOS]_H0_L0.22 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK

SEQ ID NO: 28614 - protein, 252 aa, Artificial Sequence
  Description of Artificial Sequence: Synthetic polypeptide
  XENPA58 (XENP022769 [ICOS]_H0_L0.23 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYVASSLQSGVPSRFSGSGSGTDFTLTISSLQPEDFATYYCQQAESFPWTFGQGTKVEIK

SEQ ID NO: 28615 - protein, 252 aa, Artificial Sequence
  Description of Artificial Sequence: Synthetic polypeptide
  XENPA59 (XENP022770 [ICOS]_H0_L0.24 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYAASSLQSGVPSRFSGSGSGTDFTLTISSLQPEDFATYYCQQANSFPWTFGQGTKVEIK

SEQ ID NO: 28616 - protein, 252 aa, Artificial Sequence
  Description of Artificial Sequence: Synthetic polypeptide
  XENPA60 (XENP022771 [ICOS]_H0_L0.25 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYVASSLQSGVPSRFSGSGSGTDFTLTISSLQPEDFATYYCQQAESFPWTFGQGTKVEIK

SEQ ID NO: 28617 - protein, 252 aa, Artificial Sequence
  Description of Artificial Sequence: Synthetic polypeptide
  XENPA61 (XENP022772 [ICOS]_H0_L0.26 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYAASSLQSGVPSRFSGSGSGTDFTLTISSLQPEDFATYYCQQAESFPWTFGQGTKVEIK

SEQ ID NO: 28618 - protein, 252 aa, Artificial Sequence
  Description of Artificial Sequence: Synthetic polypeptide
  XENPA62 (XENP022773 [ICOS]_H0_L0.27 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYAASSLQSGVPSRFSGSGSGTDFTLTISSLQPEDFATYYCQQANSFPWTFGQGTKVEIK

SEQ ID NO: 28619 - protein, 252 aa, Artificial Sequence
  Description of Artificial Sequence: Synthetic polypeptide
  XENPA63 (XENP022774 [ICOS]_H0_L0.28 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYVASSLQSGVPSRFSGSGSGTDFTLTISSLQPEDFATYYCQQAESFPWTFGQGTKVEIK

SEQ ID NO: 28620 - protein, 359 aa, Artificial Sequence
  Description of Artificial Sequence: Synthetic polypeptide
  XENPA64 (XENP022775 [ICOS]_H0_L0.29 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28621 - protein, 252 aa, Artificial Sequence
  Description of Artificial Sequence: Synthetic polypeptide
  XENPA65 (XENP022776 [ICOS]_H0_L0.30 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYAASSLQSGVPSRFSGSGSGTDFTLTISSLQPEDFATYYCQQAESFPWTFGQGTKVEIK

SEQ ID NO: 28622 - protein, 252 aa, Artificial Sequence
  Description of Artificial Sequence: Synthetic polypeptide
  XENPA66 (XENP022777 [ICOS]_H0_L0.31 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYAASSLQSGVPSRFSGSGSGTDFTLTISSLQPEDFATYYCQQAESFPWTFGQGTKVEIK

SEQ ID NO: 28623 - protein, 252 aa, Artificial Sequence
  Description of Artificial Sequence: Synthetic polypeptide
  XENPA67 (XENP022778 [ICOS]_H0_L0.32 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQANSFPWTFGQGTKVEIK

SEQ ID NO: 28624 - protein, 252 aa, Artificial Sequence
  Description of Artificial Sequence: Synthetic polypeptide
  XENPA68 (XENP022779 [ICOS]_H0_L0.33 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQANSFPWTFGQGTKVEIK

SEQ ID NO: 28625 - protein, 252 aa, Artificial Sequence
  Description of Artificial Sequence: Synthetic polypeptide
  XENPA69 (XENP022780 [ICOS]_H0_L0.34 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28626 - protein, 252 aa, Artificial Sequence
  Description of Artificial Sequence: Synthetic polypeptide
  XENPA70 (XENP022781 [ICOS]_H0_L0.35 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28627 - protein, 252 aa, Artificial Sequence
  Description of Artificial Sequence: Synthetic polypeptide
  XENPA71 (XENP022782 [ICOS]_H0_L0.36 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28628 - protein, 252 aa, Artificial Sequence
  Description of Artificial Sequence: Synthetic polypeptide
  XENPA72 (XENP022783 [ICOS]_H0_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28629 - protein, 252 aa, Artificial Sequence
  Description of Artificial Sequence: Synthetic polypeptide
  XENPA73 (XENP022784 [ICOS]_H0_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28630 - protein, 252 aa, Artificial Sequence
  Description of Artificial Sequence: Synthetic polypeptide
  XENPA74 (XENP022860 [ICOS]_H0_L0.42 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28631 - protein, 252 aa, Artificial Sequence
  Description of Artificial Sequence: Synthetic polypeptide
  XENPA75 (XENP022861 [ICOS]_H0_L0.43 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28632 - protein, 252 aa, Artificial Sequence
  Description of Artificial Sequence: Synthetic polypeptide
  XENPA76 (XENP022862 [ICOS]_H0_L0.44 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28633 - protein, 252 aa, Artificial Sequence
  Description of Artificial Sequence: Synthetic polypeptide
  XENPA77 (XENP022863 [ICOS]_H0.35_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28634 - protein, 252 aa, Artificial Sequence
  Description of Artificial Sequence: Synthetic polypeptide
  XENPA78 (XENP022864 [ICOS]_H0.35_L0.42 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28635 - protein, 252 aa, Artificial Sequence
  Description of Artificial Sequence: Synthetic polypeptide
  XENPA79 (XENP022865 [ICOS]_H0.35_L0.43 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28636 - protein, 252 aa, Artificial Sequence
  Description of Artificial Sequence: Synthetic polypeptide
  XENPA80 (XENP022866 [ICOS]_H0.35_L0.44 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28637 - protein, 252 aa, Artificial Sequence
  Description of Artificial Sequence: Synthetic polypeptide
  XENPA81 (XENP022867 [ICOS]_H0.61_L0.38 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28638 - protein, 252 aa, Artificial Sequence
  Description of Artificial Sequence: Synthetic polypeptide
  XENPA82 (XENP022868 [ICOS]_H0.61_L0.42 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28639 - protein, 252 aa, Artificial Sequence
  Description of Artificial Sequence: Synthetic polypeptide
  XENPA83 (XENP022869 [ICOS]_H0.61_L0.43 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28640 - protein, 252 aa, Artificial Sequence
  Description of Artificial Sequence: Synthetic polypeptide
  XENPA84 (XENP022870 [ICOS]_H0.61_L0.44 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28641 - protein, 252 aa, Artificial Sequence
  Description of Artificial Sequence: Synthetic polypeptide
  XENPA85 (XENP022871 [ICOS]_H0.24_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28642 - protein, 252 aa, Artificial Sequence
  Description of Artificial Sequence: Synthetic polypeptide
  XENPA86 (XENP022872 [ICOS]_H0.37_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28643 - protein, 252 aa, Artificial Sequence
  Description of Artificial Sequence: Synthetic polypeptide
  XENPA87 (XENP022873 [ICOS]_H0.40_L0.38 scFv)
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28644 - protein, 252 aa, Artificial Sequence
  Description of Artificial Sequence: Synthetic polypeptide
  XENPA88 (XENP022874 [ICOS]_H0.44_L0.38 scFv)
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28645 - protein, 252 aa, Artificial Sequence
  Description of Artificial Sequence: Synthetic polypeptide
  XENPA89 (XENP022875 [ICOS]_H0.56_L0.38 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28646 - protein, 252 aa, Artificial Sequence
  Description of Artificial Sequence: Synthetic polypeptide
  XENPA90 (XENP022876 [ICOS]_H0.62_L0.38 scFv)
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28647 - protein, 252 aa, Artificial Sequence
  Description of Artificial Sequence: Synthetic polypeptide
  XENPA91 (XENP022929 [ICOS]_H0.35_L0.36 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28648 - protein, 252 aa, Artificial Sequence
  Description of Artificial Sequence: Synthetic polypeptide
  XENPA92 (XENP022930 [ICOS]_H0.61_L0.36 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28649 - protein, 252 aa, Artificial Sequence
  Description of Artificial Sequence: Synthetic polypeptide
  XENPA93 (XENP022938 [ICOS]_H0.24_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28650 - protein, 252 aa, Artificial Sequence
  Description of Artificial Sequence: Synthetic polypeptide
  XENPA94 (XENP022939 [ICOS]_H0.37_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28651 - protein, 252 aa, Artificial Sequence
  Description of Artificial Sequence: Synthetic polypeptide
  XENPA95 (XENP022940 [ICOS]_H0.40_L0.37 scFv)
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28652 - protein, 252 aa, Artificial Sequence
  Description of Artificial Sequence: Synthetic polypeptide
  XENPA96 (XENP022941 [ICOS]_H0.44_L0.37 scFv)
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28653 - protein, 252 aa, Artificial Sequence
  Description of Artificial Sequence: Synthetic polypeptide
  XENPA97 (XENP022942 [ICOS]_H0.56_L0.37 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28654 - protein, 252 aa, Artificial Sequence
  Description of Artificial Sequence: Synthetic polypeptide
  XENPA98 (XENP022943 [ICOS]_H0.62_L0.37 scFv)
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28655 - protein, 252 aa, Artificial Sequence
  Description of Artificial Sequence: Synthetic polypeptide
  XENPA99 (XENP022944 [ICOS]_H0.35_L0.34 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28656 - protein, 252 aa, Artificial Sequence
  Description of Artificial Sequence: Synthetic polypeptide
  XENPA100 (XENP022945 [ICOS]_H0.35_L0.35 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28657 - protein, 252 aa, Artificial Sequence
  Description of Artificial Sequence: Synthetic polypeptide
  XENPA101 (XENP022946 [ICOS]_H0.35_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28658 - protein, 252 aa, Artificial Sequence
  Description of Artificial Sequence: Synthetic polypeptide
  XENPA102 (XENP022947 [ICOS]_H0.61_L0.34 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28659 - protein, 252 aa, Artificial Sequence
  Description of Artificial Sequence: Synthetic polypeptide
  XENPA103 (XENP022948 [ICOS]_H0.61_L0.35 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28660 - protein, 252 aa, Artificial Sequence
  Description of Artificial Sequence: Synthetic polypeptide
  XENPA104 (XENP022949 [ICOS]_H0.61_L0.37 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28661 - protein, 252 aa, Artificial Sequence
  Description of Artificial Sequence: Synthetic polypeptide
  XENPA105 (XENP023086 [ICOS]_H0.37_L0 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28662 - protein, 252 aa, Artificial Sequence
  Description of Artificial Sequence: Synthetic polypeptide
  XENPA106 (XENP023087 [ICOS]_H0.64_L0 scFv)
QVQLVQSGAEVKKPGASVKVSCKASGYTFTGYYMHWVRQAPGQGLEWMGWINPHSGGTNYAQKFQGRVTMTEDTSTDTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28663 - protein, 252 aa, Artificial Sequence
  Description of Artificial Sequence: Synthetic polypeptide
  XENPA107 (XENP023088 [ICOS]_H0.66_L0 scFv)
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28664 - protein, 252 aa, Artificial Sequence
  Description of Artificial Sequence: Synthetic polypeptide
  XENPA108 (XENP023089 [ICOS]_H0.67_L0 scFv)
QVQLVQSGAEVKKPGASVKVSCKASGYTFTGYYMHWVRQAPGQGLEWMGWINPHSGETIYAQKFQGRVTMTEDTSTDTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28665 - protein, 252 aa, Artificial Sequence
  Description of Artificial Sequence: Synthetic polypeptide
  XENPA109 (XENP023409 [ICOS]_H0.66_L0.34 scFv)
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28666 - protein, 6 aa, Artificial Sequence
  Description of Artificial Sequence: Synthetic 6xHis tag
HHHHHH

SEQ ID NO: 28667 - protein, 13 aa, Artificial Sequence
  Description of Artificial Sequence: Synthetic peptide
ASTKGPSVFPLAP

SEQ ID NO: 28668 - protein, 13 aa, Artificial Sequence
  Description of Artificial Sequence: Synthetic peptide
RTVAAPSVFIFPP

SEQ ID NO: 28669 - protein, 329 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28670 - protein, 231 aa, Artificial Sequence; identical to SEQ ID NO: 2397
  Description of Artificial Sequence: Synthetic polypeptide
  scFv Heavy chain

SEQ ID NO: 28671 - protein, 107 aa, Artificial Sequence [sequence omitted]

SEQ ID NO: 28672 - protein, 329 aa, Artificial Sequence; identical to SEQ ID NO: 28669
  Description of Artificial Sequence: Synthetic polypeptide
  Fab side Heavy chain

SEQ ID NO: 28673 - protein, 231 aa, Artificial Sequence
  Description of Artificial Sequence: Synthetic polypeptide
  scFv Heavy chain
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28674 - protein, 329 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 28675 - protein, 231 aa, Artificial Sequence; identical to SEQ ID NO: 28673
  Description of Artificial Sequence: Synthetic polypeptide
  scFv Heavy chain

SEQ ID NO: 28676 - protein, 330 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQKSLSLSPGK

SEQ ID NO: 28677 - protein, 231 aa, Artificial Sequence
  Description of Artificial Sequence: Synthetic polypeptide
  scFv Heavy chain
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 28678 - protein, 329 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28679 - protein, 231 aa, Artificial Sequence
  Description of Artificial Sequence: Synthetic polypeptide
  scFv Heavy chain
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28680 - protein, 329 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28681 - protein, 231 aa, Artificial Sequence; identical to SEQ ID NO: 28679
  Description of Artificial Sequence: Synthetic polypeptide
  scFv Heavy chain

SEQ ID NO: 28682 - protein, 329 aa, Artificial Sequence
  Description of Artificial Sequence: Synthetic polypeptide
  Fab side Heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28683 - protein, 231 aa, Artificial Sequence
  Description of Artificial Sequence: Synthetic polypeptide
  scFv Heavy chain
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28684 - protein, 327 aa, Artificial Sequence
  Description of Artificial Sequence: Synthetic polypeptide
  Fab side Heavy chain
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSLSLSLGK

SEQ ID NO: 28685 - protein, 229 aa, Artificial Sequence
  Description of Artificial Sequence: Synthetic polypeptide
  scFv Heavy chain
ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 28686 - protein, 326 aa, Artificial Sequence
  Description of Artificial Sequence: Synthetic polypeptide
  Fab side Heavy chain
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 28687 - protein, 228 aa, Artificial Sequence
  Description of Artificial Sequence: Synthetic polypeptide
  scFv Heavy chain
ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 28688 - protein, 326 aa, Artificial Sequence
  Description of Artificial Sequence: Synthetic polypeptide
  Fab side Heavy chain
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 28689 - protein, 228 aa, Artificial Sequence
  Description of Artificial Sequence: Synthetic polypeptide
  scFv Heavy chain
ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 28690 - protein, 442 aa, Artificial Sequence; identical to SEQ ID NO: 16161
  Description of Artificial Sequence: Synthetic polypeptide
  XENP016432 Nivolumab_H0L0_IgG1_PVA_/S267K Heavy chain

SEQ ID NO: 28691 - protein, 113 aa, Artificial Sequence [sequence omitted]

SEQ ID NO: 28692 - protein, 5 aa, Artificial Sequence
  Description of Artificial Sequence: Synthetic peptide
  XENP016432 vhCDR1
NSGMH

SEQ ID NO: 28693 - protein, 17 aa, Artificial Sequence
  Description of Artificial Sequence: Synthetic peptide
  XENP016432 vhCDR2
VIWYDGSKRYYADSVKG

SEQ ID NO: 28694 - protein, 4 aa, Artificial Sequence
  Description of Artificial Sequence: Synthetic peptide
  XENP016432 vhCDR3
NDDY

SEQ ID NO: 28695 - protein, 214 aa, Artificial Sequence; identical to SEQ ID NO: 16146
  Description of Artificial Sequence: Synthetic polypeptide
  XENP016432 Nivolumab_H0L0_IgG1_PVA_/S267K Light chain

SEQ ID NO: 28696 - protein, 107 aa, Artificial Sequence [sequence omitted]

SEQ ID NO: 28697 - protein, 11 aa, Artificial Sequence
  Description of Artificial Sequence: Synthetic peptide
  XENP016432 vlCDR1
RASQSVSSYLA

SEQ ID NO: 28698 - protein, 7 aa, Artificial Sequence
  Description of Artificial Sequence: Synthetic peptide
  XENP016432 vlCDR2
DASNRAT

SEQ ID NO: 28699 - protein, 9 aa, Artificial Sequence
  Description of Artificial Sequence: Synthetic peptide
  XENP016432 vlCDR3
QQSSNWPRT

SEQ ID NO: 28700 - protein, 456 aa, Artificial Sequence; identical to SEQ ID NO: 27536
  Description of Artificial Sequence: Synthetic polypeptide
  XENP024120 LOPD180[PD-1]_H1L1_IgG1_PVA_/S267K Heavy chain

SEQ ID NO: 28701 - protein, 127 aa, Artificial Sequence; identical to SEQ ID NO: 26823
  Description of Artificial Sequence: Synthetic polypeptide
  VH of XENP024120

SEQ ID NO: 28702 - protein, 7 aa, Artificial Sequence
  Description of Artificial Sequence: Synthetic peptide
  XENP024120 vhCDR1
SGAYYWS

SEQ ID NO: 28703 - protein, 16 aa, Artificial Sequence
  Description of Artificial Sequence: Synthetic peptide
  XENP024120 vhCDR2
YIYYNGNTYYNPSLRS

SEQ ID NO: 28704 - protein, 17 aa, Artificial Sequence
  Description of Artificial Sequence: Synthetic peptide
  XENP024120 vhCDR3
ASDYVWGGYHYFDAFDL

SEQ ID NO: 28705 - protein, 216 aa, Artificial Sequence; identical to SEQ ID NO: 26837
  Description of Artificial Sequence: Synthetic polypeptide
  XENP024120 LOPD180[PD-1]_H1L1_IgG1_PVA_/S267K Light chain

SEQ ID NO: 28706 - protein, 110 aa, Artificial Sequence; identical to SEQ ID NO: 26838
  Description of Artificial Sequence: Synthetic polypeptide
  VL of XENP024120

SEQ ID NO: 28707 - protein, 13 aa, Artificial Sequence
  Description of Artificial Sequence: Synthetic peptide
  XENP024120 vlCDR1
SGSNSNIGSNSVN

SEQ ID NO: 28708 - protein, 7 aa, Artificial Sequence
  Description of Artificial Sequence: Synthetic peptide
  XENP024120 vlCDR2
GNNQRPS

SEQ ID NO: 28709 - protein, 11 aa, Artificial Sequence
  Description of Artificial Sequence: Synthetic peptide
  XENP024120 vlCDR3
AAWDDSLNGPV

SEQ ID NO: 28710 - protein, 452 aa, Artificial Sequence; identical to SEQ ID NO: 26682
  Description of Artificial Sequence: Synthetic polypeptide
  XENP024121 mAb7(1.2)[PD-1]_H1L1_IgG1_PVA_/S267K Heavy chain

SEQ ID NO: 28711 - protein, 123 aa, Artificial Sequence; identical to SEQ ID NO: 26303
  Description of Artificial Sequence: Synthetic polypeptide
  VH of XENP024121

SEQ ID NO: 28712 - protein, 5 aa, Artificial Sequence
  Description of Artificial Sequence: Synthetic peptide
  XENP024121 vhCDR1
TYWMH

SEQ ID NO: 28713 - protein, 17 aa, Artificial Sequence
  Description of Artificial Sequence: Synthetic peptide
  XENP024121 vhCDR2
EIDPSDSYVNYNQNFKG

SEQ ID NO: 28714 - protein, 14 aa, Artificial Sequence
  Description of Artificial Sequence: Synthetic peptide
  XENP024121 vhCDR3
SPDYYGTSLAWFDY

SEQ ID NO: 28715 - protein, 218 aa, Artificial Sequence; identical to SEQ ID NO: 27551
  Description of Artificial Sequence: Synthetic polypeptide
  XENP024121 mAb7(1.2)[PD-1]_H1L1_IgG1_PVA_/S267K Light chain

SEQ ID NO: 28716 - protein, 111 aa, Artificial Sequence; identical to SEQ ID NO: 27008
  Description of Artificial Sequence: Synthetic polypeptide
  VL of XENP024121

SEQ ID NO: 28717 - protein, 15 aa, Artificial Sequence
  Description of Artificial Sequence: Synthetic peptide
  XENP024121 vlCDR1
RASESVDNYGMSFMN

SEQ ID NO: 28718 - protein, 7 aa, Artificial Sequence
  Description of Artificial Sequence: Synthetic peptide
  XENP024121 vlCDR2
AASNQGS

SEQ ID NO: 28719 - protein, 9 aa, Artificial Sequence
  Description of Artificial Sequence: Synthetic peptide
  XENP024121 vlCDR3
QQSKEVPYT

SEQ ID NO: 28720 - protein, 451 aa, Artificial Sequence; identical to SEQ ID NO: 21381
  Description of Artificial Sequence: Synthetic polypeptide
  XENP019686 1G6_H1.279_L1.194_IgG1_PVA_/S267K Heavy chain

SEQ ID NO: 28721 - protein, 122 aa, Artificial Sequence; identical to SEQ ID NO: 2872
  Description of Artificial Sequence: Synthetic polypeptide
  VH of XENP019686

SEQ ID NO: 28722 - protein, 5 aa, Artificial Sequence
  Description of Artificial Sequence: Synthetic peptide
  XENP019686 vhCDR1
NYWMN

SEQ ID NO: 28723 - protein, 19 aa, Artificial Sequence
  Description of Artificial Sequence: Synthetic peptide
  XENP019686 vhCDR2
EIRLYSNNYATHYAESVKG

SEQ ID NO: 28724 - protein, 11 aa, Artificial Sequence
  Description of Artificial Sequence: Synthetic peptide
  XENP019686 vhCDR3
YYGNYGGYFDV

SEQ ID NO: 28725 - protein, 214 aa, Artificial Sequence; identical to SEQ ID NO: 21486
  Description of Artificial Sequence: Synthetic polypeptide
  XENP019686 1G6_H1.279_L1.194_IgG1_PVA_/S267K Light chain

SEQ ID NO: 28726 - protein, 107 aa, Artificial Sequence; identical to SEQ ID NO: 2871
  Description of Artificial Sequence: Synthetic polypeptide
  VL of XENP019686

SEQ ID NO: 28727 - protein, 11 aa, Artificial Sequence
  Description of Artificial Sequence: Synthetic peptide
  XENP019686 vlCDR1
RASQSVGNDVA

SEQ ID NO: 28728 - protein, 7 aa, Artificial Sequence
  Description of Artificial Sequence: Synthetic peptide
  XENP019686 vlCDR2
YASHRYT

SEQ ID NO: 28729 - protein, 9 aa, Artificial Sequence
  Description of Artificial Sequence: Synthetic peptide
  XENP019686 vlCDR3
QQDFSSPRT

SEQ ID NO: 28730 - protein, 449 aa, Artificial Sequence; identical to SEQ ID NO: 21751
  Description of Artificial Sequence: Synthetic polypeptide
  XENP020156 2E9_H1L1_IgG1_PVA_/S267K Heavy chain

SEQ ID NO: 28731 - protein, 120 aa, Artificial Sequence; identical to SEQ ID NO: 3091
  Description of Artificial Sequence: Synthetic polypeptide
  VH of XENP020156

SEQ ID NO: 28732 - protein, 5 aa, Artificial Sequence
  Description of Artificial Sequence: Synthetic peptide
  XENP020156 vhCDR1
NYWLG

SEQ ID NO: 28733 - protein, 17 aa, Artificial Sequence
  Description of Artificial Sequence: Synthetic peptide
  XENP020156 vhCDR2
NFYPGSSNTYYNEKFQG

SEQ ID NO: 28734 - protein, 11 aa, Artificial Sequence
  Description of Artificial Sequence: Synthetic peptide
  XENP020156 vhCDR3
HYGTNYRYFDV

SEQ ID NO: 28735 - protein, 214 aa, Artificial Sequence; identical to SEQ ID NO: 3140
  Description of Artificial Sequence: Synthetic polypeptide
  XENP020156 2E9_H1L1_IgG1_PVA_/S267K Light chain

SEQ ID NO: 28736 - protein, 107 aa, Artificial Sequence; identical to SEQ ID NO: 3092
  Description of Artificial Sequence: Synthetic polypeptide
  VL of XENP020156

SEQ ID NO: 28737 - protein, 11 aa, Artificial Sequence
  Description of Artificial Sequence: Synthetic peptide
  XENP020156 vlCDR1
RASQSVSNDVA

SEQ ID NO: 28738 - protein, 7 aa, Artificial Sequence
  Description of Artificial Sequence: Synthetic peptide
  XENP020156 vlCDR2
YASNRYT

SEQ ID NO: 28739 - protein, 9 aa, Artificial Sequence
  Description of Artificial Sequence: Synthetic peptide
  XENP020156 vlCDR3
QQDYSSPYT

SEQ ID NO: 28740 - protein, 447 aa, Artificial Sequence; identical to SEQ ID NO: 27506
  Description of Artificial Sequence: Synthetic polypeptide
  XENP016434 YW243.55.S70[PD-L1]_H0L0_IgG1_PVA_/S267K Heavy chain

SEQ ID NO: 28741 - protein, 118 aa, Artificial Sequence [sequence omitted]

SEQ ID NO: 28742 - protein, 5 aa, Artificial Sequence
  Description of Artificial Sequence: Synthetic peptide
  XENP016434 vhCDR1
DSWIH

SEQ ID NO: 28743 - protein, 17 aa, Artificial Sequence
  Description of Artificial Sequence: Synthetic peptide
  XENP016434 vhCDR2
WISPYGGSTYYADSVKG

SEQ ID NO: 28744 - protein, 9 aa, Artificial Sequence
  Description of Artificial Sequence: Synthetic peptide
  XENP016434 vhCDR3
RHWPGGFDY

SEQ ID NO: 28745 - protein, 214 aa, Artificial Sequence; identical to SEQ ID NO: 27132
  Description of Artificial Sequence: Synthetic polypeptide
  XENP016434 YW243.55.S70[PD-L1]_H0L0_IgG1_PVA_/S267K Light chain

SEQ ID NO: 28746 - protein, 107 aa, Artificial Sequence [sequence omitted]

SEQ ID NO: 28747 - protein, 11 aa, Artificial Sequence
  Description of Artificial Sequence: Synthetic peptide
  XENP016434 vlCDR1
RASQDVSTAVA

SEQ ID NO: 28748 - protein, 7 aa, Artificial Sequence
  Description of Artificial Sequence: Synthetic peptide
  XENP016434 vlCDR2
SASFLYS

SEQ ID NO: 28749 - protein, 9 aa, Artificial Sequence
  Description of Artificial Sequence: Synthetic peptide
  XENP016434 vlCDR3
QQYLYHPAT

SEQ ID NO: 28750 - protein, 449 aa, Artificial Sequence; identical to SEQ ID NO: 27516
  Description of Artificial Sequence: Synthetic polypeptide
  XENP024118 avelumab[PD-L1]_H1L1_IgG1_PVA_/S267K Heavy chain

SEQ ID NO: 28751 - protein, 120 aa, Artificial Sequence; identical to SEQ ID NO: 3977
  Description of Artificial Sequence: Synthetic polypeptide
  VH of XENP024118

SEQ ID NO: 28752 - protein, 5 aa, Artificial Sequence
  Description of Artificial Sequence: Synthetic peptide
  XENP024118 vhCDR1
SYIMM

SEQ ID NO: 28753 - protein, 17 aa, Artificial Sequence
  Description of Artificial Sequence: Synthetic peptide
  XENP024118 vhCDR2
SIYPSGGITFYADTVKG

SEQ ID NO: 28754 - protein, 11 aa, Artificial Sequence
  Description of Artificial Sequence: Synthetic peptide
  XENP024118 vhCDR3
IKLGTVTTVDY

SEQ ID NO: 28755 - protein, 216 aa, Artificial Sequence; identical to SEQ ID NO: 27172
  Description of Artificial Sequence: Synthetic polypeptide
  XENP024118 avelumab[PD-L1]_H1L1_IgG1_PVA_/S267K Light chain

SEQ ID NO: 28756 - protein, 110 aa, Artificial Sequence; identical to SEQ ID NO: 3981
  Description of Artificial Sequence: Synthetic polypeptide
  VL of XENP024118

SEQ ID NO: 28757 - protein, 14 aa, Artificial Sequence
  Description of Artificial Sequence: Synthetic peptide
  XENP024118 vlCDR1
TGTSSDVGGYNYVS

SEQ ID NO: 28758 - protein, 7 aa, Artificial Sequence
  Description of Artificial Sequence: Synthetic peptide
  XENP024118 vlCDR2
DVSNRPS

SEQ ID NO: 28759 - protein, 10 aa, Artificial Sequence
  Description of Artificial Sequence: Synthetic peptide
  XENP024118 vlCDR3
SSYTSSSTRV

SEQ ID NO: 28760 - protein, 450 aa, Artificial Sequence; identical to SEQ ID NO: 27526
  Description of Artificial Sequence: Synthetic polypeptide
  XENP024119 durvalumab[PD-L1]_H1L1_IgG1_PVA_/S267K Heavy chain

SEQ ID NO: 28761 - protein, 121 aa, Artificial Sequence; identical to SEQ ID NO: 3961
  Description of Artificial Sequence: Synthetic polypeptide
  VH of XENP024119

SEQ ID NO: 28762 - protein, 5 aa, Artificial Sequence
  Description of Artificial Sequence: Synthetic peptide
  XENP024119 vhCDR1
RYWMS

SEQ ID NO: 28763 - protein, 17 aa, Artificial Sequence
  Description of Artificial Sequence: Synthetic peptide
  XENP024119 vhCDR2
NIKQDGSEKYYVDSVKG

SEQ ID NO: 28764 - protein, 12 aa, Artificial Sequence
  Description of Artificial Sequence: Synthetic peptide
  XENP024119 vhCDR3
EGGWFGELAFDY

SEQ ID NO: 28765 - protein, 215 aa, Artificial Sequence; identical to SEQ ID NO: 27152
  Description of Artificial Sequence: Synthetic polypeptide
  XENP024119 durvalumab[PD-L1]_H1L1_IgG1_PVA_/S267K Light chain

SEQ ID NO: 28766 - protein, 108 aa, Artificial Sequence; identical to SEQ ID NO: 3965
  Description of Artificial Sequence: Synthetic polypeptide
  VL of XENP024119

SEQ ID NO: 28767 - protein, 12 aa, Artificial Sequence
  Description of Artificial Sequence: Synthetic peptide
  XENP024119 vlCDR1
RASQRVSSSYLA

SEQ ID NO: 28768 - protein, 7 aa, Artificial Sequence
  Description of Artificial Sequence: Synthetic peptide
  XENP024119 vlCDR2
DASSRAT

SEQ ID NO: 28769 - protein, 9 aa, Artificial Sequence
  Description of Artificial Sequence: Synthetic peptide
  XENP024119 vlCDR3
QQYGSLPWT

SEQ ID NO: 28770 - protein, 230 aa, Artificial Sequence; identical to SEQ ID NO: 27869
  Description of Artificial Sequence: Synthetic polypeptide
  XENP022091 [ICOS]_H0_L0.7_Fab Heavy chain

SEQ ID NO: 28771 - protein, 125 aa, Artificial Sequence; identical to SEQ ID NO: 26293
  Description of Artificial Sequence: Synthetic polypeptide
  VH of XENP022091

SEQ ID NO: 28772 - protein, 5 aa, Artificial Sequence
  Description of Artificial Sequence: Synthetic peptide
  XENP022091 vhCDR1
GYYMH

SEQ ID NO: 28773 - protein, 17 aa, Artificial Sequence
  Description of Artificial Sequence: Synthetic peptide
  XENP022091 vhCDR2
WINPHSGGTNYAQKFQG

SEQ ID NO: 28774 - protein, 16 aa, Artificial Sequence
  Description of Artificial Sequence: Synthetic peptide
  XENP022091 vhCDR3
TYYYDSSGYYHDAFDI

SEQ ID NO: 28775 - protein, 214 aa, Artificial Sequence; identical to SEQ ID NO: 26477
  Description of Artificial Sequence: Synthetic polypeptide
  XENP022091 [ICOS]_H0_L0.7_Fab Light chain

SEQ ID NO: 28776 - protein, 107 aa, Artificial Sequence; identical to SEQ ID NO: 26478
  Description of Artificial Sequence: Synthetic polypeptide
  VL of XENP022091

SEQ ID NO: 28777 - protein, 11 aa, Artificial Sequence
  Description of Artificial Sequence: Synthetic peptide
  XENP022091 vlCDR1
RASQGISSYLA

SEQ ID NO: 28778 - protein, 7 aa, Artificial Sequence
  Description of Artificial Sequence: Synthetic peptide
  XENP022091 vlCDR2
VASSLQS

SEQ ID NO: 28779 - protein, 9 aa, Artificial Sequence
  Description of Artificial Sequence: Synthetic peptide
  XENP022091 vlCDR3
QQANSFPWT

SEQ ID NO: 28780 - protein, 230 aa, Artificial Sequence; identical to SEQ ID NO: 27869
  Description of Artificial Sequence: Synthetic polypeptide
  XENP022780 [ICOS]_H0_L0.34_Fab Heavy chain

SEQ ID NO: 28781 - protein, 125 aa, Artificial Sequence; identical to SEQ ID NO: 26293
  Description of Artificial Sequence: Synthetic polypeptide
  VH of XENP022780

SEQ ID NO: 28782 - protein, 5 aa, Artificial Sequence
  Description of Artificial Sequence: Synthetic peptide
  XENP022780 vhCDR1
GYYMH

SEQ ID NO: 28783 - protein, 17 aa, Artificial Sequence
  Description of Artificial Sequence: Synthetic peptide
  XENP022780 vhCDR2
WINPHSGGTNYAQKFQG

SEQ ID NO: 28784 - protein, 16 aa, Artificial Sequence
  Description of Artificial Sequence: Synthetic peptide
  XENP022780 vhCDR3
TYYYDSSGYYHDAFDI

SEQ ID NO: 28785 - protein, 214 aa, Artificial Sequence; identical to SEQ ID NO: 26497
  Description of Artificial Sequence: Synthetic polypeptide
  XENP022780 [ICOS]_H0_L0.34_Fab Light chain

SEQ ID NO: 28786 - protein, 107 aa, Artificial Sequence; identical to SEQ ID NO: 26498
  Description of Artificial Sequence: Synthetic polypeptide
  VL of XENP022780

SEQ ID NO: 28787 - protein, 11 aa, Artificial Sequence
  Description of Artificial Sequence: Synthetic peptide
  XENP022780 vlCDR1
QASQDISRLLA

SEQ ID NO: 28788 - protein, 7 aa, Artificial Sequence
  Description of Artificial Sequence: Synthetic peptide
  XENP022780 vlCDR2
VASSLQS

SEQ ID NO: 28789 - protein, 9 aa, Artificial Sequence
  Description of Artificial Sequence: Synthetic peptide
  XENP022780 vlCDR3
QQAESFPWT

SEQ ID NO: 28790 - protein, 230 aa, Artificial Sequence; identical to SEQ ID NO: 27869
  Description of Artificial Sequence: Synthetic polypeptide
  XENP022782 [ICOS]_H0_L0.36_Fab Heavy chain

SEQ ID NO: 28791 - protein, 125 aa, Artificial Sequence; identical to SEQ ID NO: 26293
  Description of Artificial Sequence: Synthetic polypeptide
  VH of XENP022782

SEQ ID NO: 28792 - protein, 5 aa, Artificial Sequence
  Description of Artificial Sequence: Synthetic peptide
  XENP022782 vhCDR1
GYYMH

SEQ ID NO: 28793 - protein, 17 aa, Artificial Sequence
  Description of Artificial Sequence: Synthetic peptide
  XENP022782 vhCDR2
WINPHSGGTNYAQKFQG

SEQ ID NO: 28794 - protein, 16 aa, Artificial Sequence
  Description of Artificial Sequence: Synthetic peptide
  XENP022782 vhCDR3
TYYYDSSGYYHDAFDI

SEQ ID NO: 28795 - protein, 214 aa, Artificial Sequence; identical to SEQ ID NO: 26517
  Description of Artificial Sequence: Synthetic polypeptide
  XENP022782 [ICOS]_H0_L0.36_Fab Light chain

SEQ ID NO: 28796 - protein, 107 aa, Artificial Sequence; identical to SEQ ID NO: 26518
  Description of Artificial Sequence: Synthetic polypeptide
  VL of XENP022782

SEQ ID NO: 28797 - protein, 11 aa, Artificial Sequence
  Description of Artificial Sequence: Synthetic peptide
  XENP022782 vlCDR1
QASQDISSLLA

SEQ ID NO: 28798 - protein, 7 aa, Artificial Sequence
  Description of Artificial Sequence: Synthetic peptide
  XENP022782 vlCDR2
VASSLQS

SEQ ID NO: 28799 - protein, 9 aa, Artificial Sequence
  Description of Artificial Sequence: Synthetic peptide
  XENP022782 vlCDR3
QQAESFPWT

SEQ ID NO: 28800 - protein, 230 aa, Artificial Sequence; identical to SEQ ID NO: 27869
  Description of Artificial Sequence: Synthetic polypeptide
  XENP022783 [ICOS]_H0_L0.37_Fab Heavy chain

SEQ ID NO: 28801 - protein, 125 aa, Artificial Sequence; identical to SEQ ID NO: 26293
  Description of Artificial Sequence: Synthetic polypeptide
  VH of XENP022783

SEQ ID NO: 28802 - protein, 5 aa, Artificial Sequence
  Description of Artificial Sequence: Synthetic peptide
  XENP022783 vhCDR1
GYYMH

SEQ ID NO: 28803 - protein, 17 aa, Artificial Sequence
  Description of Artificial Sequence: Synthetic peptide
  XENP022783 vhCDR2
WINPHSGGTNYAQKFQG

SEQ ID NO: 28804 - protein, 16 aa, Artificial Sequence
  Description of Artificial Sequence: Synthetic peptide
  XENP022783 vhCDR3
TYYYDSSGYYHDAFDI

SEQ ID NO: 28805 - protein, 214 aa, Artificial Sequence; identical to SEQ ID NO: 26537
  Description of Artificial Sequence: Synthetic polypeptide
  XENP022783 [ICOS]_H0_L0.37_Fab Light chain

SEQ ID NO: 28806 - protein, 107 aa, Artificial Sequence; identical to SEQ ID NO: 26538
  Description of Artificial Sequence: Synthetic polypeptide
  VL of XENP022783

SEQ ID NO: 28807 - protein, 11 aa, Artificial Sequence
  Description of Artificial Sequence: Synthetic peptide
  XENP022783 vlCDR1
QASQDISRLLA

SEQ ID NO: 28808 - protein, 7 aa, Artificial Sequence
  Description of Artificial Sequence: Synthetic peptide
  XENP022783 vlCDR2
AASSLQS

SEQ ID NO: 28809 - protein, 9 aa, Artificial Sequence
  Description of Artificial Sequence: Synthetic peptide
  XENP022783 vlCDR3
QQAESFPWT

SEQ ID NO: 28810 - protein, 230 aa, Artificial Sequence; identical to SEQ ID NO: 27869
  Description of Artificial Sequence: Synthetic polypeptide
  XENP022784 [ICOS]_H0_L0.38_Fab Heavy chain

SEQ ID NO: 28811 - protein, 125 aa, Artificial Sequence; identical to SEQ ID NO: 26293
  Description of Artificial Sequence: Synthetic polypeptide
  VH of XENP022784

SEQ ID NO: 28812 - protein, 5 aa, Artificial Sequence
  Description of Artificial Sequence: Synthetic peptide
  XENP022784 vhCDR1
GYYMH

SEQ ID NO: 28813 - protein, 17 aa, Artificial Sequence
  Description of Artificial Sequence: Synthetic peptide
  XENP022784 vhCDR2
WINPHSGGTNYAQKFQG

SEQ ID NO: 28814 - protein, 16 aa, Artificial Sequence
  Description of Artificial Sequence: Synthetic peptide
  XENP022784 vhCDR3
TYYYDSSGYYHDAFDI

SEQ ID NO: 28815 - protein, 214 aa, Artificial Sequence; identical to SEQ ID NO: 26557
  Description of Artificial Sequence: Synthetic polypeptide
  XENP022784 [ICOS]_H0_L0.38_Fab Light chain

SEQ ID NO: 28816 - protein, 107 aa, Artificial Sequence; identical to SEQ ID NO: 26558
  Description of Artificial Sequence: Synthetic polypeptide
  VL of XENP022784

SEQ ID NO: 28817 - protein, 11 aa, Artificial Sequence
  Description of Artificial Sequence: Synthetic peptide
  XENP022784 vlCDR1
QASQDISSLLA

SEQ ID NO: 28818 - protein, 7 aa, Artificial Sequence
  Description of Artificial Sequence: Synthetic peptide
  XENP022784 vlCDR2
AASSLQS

SEQ ID NO: 28819 - protein, 9 aa, Artificial Sequence
  Description of Artificial Sequence: Synthetic peptide
  XENP022784 vlCDR3
QQAESFPWT

SEQ ID NO: 28820 - protein, 230 aa, Artificial Sequence; identical to SEQ ID NO: 28081
  Description of Artificial Sequence: Synthetic polypeptide
  XENP023088 [ICOS]_H0.66_L0_Fab Heavy chain

SEQ ID NO: 28821 - protein, 125 aa, Artificial Sequence; identical to SEQ ID NO: 26563
  Description of Artificial Sequence: Synthetic polypeptide
  VH of XENP023088

SEQ ID NO: 28822 - protein, 5 aa, Artificial Sequence
  Description of Artificial Sequence: Synthetic peptide
  XENP023088 vhCDR1
GYYMH

SEQ ID NO: 28823 - protein, 17 aa, Artificial Sequence
  Description of Artificial Sequence: Synthetic peptide
  XENP023088 vhCDR2
WINPHSGETIYAQKFQG

SEQ ID NO: 28824 - protein, 16 aa, Artificial Sequence
  Description of Artificial Sequence: Synthetic peptide
  XENP023088 vhCDR3
TYYYDTSGYYHDAFDV

SEQ ID NO: 28825 - protein, 214 aa, Artificial Sequence; identical to SEQ ID NO: 26297
  Description of Artificial Sequence: Synthetic polypeptide
  XENP023088 [ICOS]_H0.66_L0_Fab Light chain

SEQ ID NO: 28826 - protein, 107 aa, Artificial Sequence; identical to SEQ ID NO: 26298
  Description of Artificial Sequence: Synthetic polypeptide
  VL of XENP023088

SEQ ID NO: 28827 - protein, 11 aa, Artificial Sequence
  Description of Artificial Sequence: Synthetic peptide
  XENP023088 vlCDR1
RASQGISRLLA

SEQ ID NO: 28828 - protein, 7 aa, Artificial Sequence
  Description of Artificial Sequence: Synthetic peptide
  XENP023088 vlCDR2
VASSLQS

SEQ ID NO: 28829 - protein, 9 aa, Artificial Sequence
  Description of Artificial Sequence: Synthetic peptide
  XENP023088 vlCDR3
QQANSFPWT

SEQ ID NO: 28830 - protein, 230 aa, Artificial Sequence; identical to SEQ ID NO: 28081
  Description of Artificial Sequence: Synthetic polypeptide
  XENP023409 [ICOS]_H0.66_L0.34_Fab Heavy chain

SEQ ID NO: 28831 - protein, 125 aa, Artificial Sequence; identical to SEQ ID NO: 26563
  Description of Artificial Sequence: Synthetic polypeptide
  VH of XENP023409

SEQ ID NO: 28832 - protein, 5 aa, Artificial Sequence
  Description of Artificial Sequence: Synthetic peptide
  XENP023409 vhCDR1
GYYMH

SEQ ID NO: 28833 - protein, 17 aa, Artificial Sequence
  Description of Artificial Sequence: Synthetic peptide
  XENP023409 vhCDR2
WINPHSGETIYAQKFQG

SEQ ID NO: 28834 - protein, 16 aa, Artificial Sequence
  Description of Artificial Sequence: Synthetic peptide
  XENP023409 vhCDR3
TYYYDTSGYYHDAFDV

SEQ ID NO: 28835 - protein, 214 aa, Artificial Sequence; identical to SEQ ID NO: 26497
  Description of Artificial Sequence: Synthetic polypeptide
  XENP023409 [ICOS]_H0.66_L0.34_Fab Light chain

SEQ ID NO: 28836 - protein, 107 aa, Artificial Sequence; identical to SEQ ID NO: 26498
  Description of Artificial Sequence: Synthetic polypeptide
  VL of XENP023409

SEQ ID NO: 28837 - protein, 11 aa, Artificial Sequence
  Description of Artificial Sequence: Synthetic peptide
  XENP023409 vlCDR1
QASQDISRLLA

SEQ ID NO: 28838 - protein, 7 aa, Artificial Sequence
  Description of Artificial Sequence: Synthetic peptide
  XENP023409 vlCDR2
VASSLQS

SEQ ID NO: 28839 - protein, 9 aa, Artificial Sequence
  Description of Artificial Sequence: Synthetic peptide
  XENP023409 vlCDR3
QQAESFPWT

SEQ ID NO: 28840 - protein, 125 aa, Artificial Sequence; identical to SEQ ID NO: 26293
  Description of Artificial Sequence: Synthetic polypeptide
  VH of XENP024352

SEQ ID NO: 28841 - protein, 5 aa, Artificial Sequence
  Description of Artificial Sequence: Synthetic peptide
  XENP024352 vhCDR1
GYYMH

SEQ ID NO: 28842 - protein, 17 aa, Artificial Sequence
  Description of Artificial Sequence: Synthetic peptide
  XENP024352 vhCDR2
WINPHSGGTNYAQKFQG

SEQ ID NO: 28843 - protein, 16 aa, Artificial Sequence
  Description of Artificial Sequence: Synthetic peptide
  XENP024352 vhCDR3
TYYYDSSGYYHDAFDI

SEQ ID NO: 28844 - protein, 107 aa, Artificial Sequence; identical to SEQ ID NO: 26298
  Description of Artificial Sequence: Synthetic polypeptide
  VL of XENP024352

SEQ ID NO: 28845 - protein, 11 aa, Artificial Sequence
  Description of Artificial Sequence: Synthetic peptide
  XENP024352 vlCDR1
RASQGISRLLA

SEQ ID NO: 28846 - protein, 7 aa, Artificial Sequence
  Description of Artificial Sequence: Synthetic peptide
  XENP024352 vlCDR2
VASSLQS

SEQ ID NO: 28847 - protein, 9 aa, Artificial Sequence
  Description of Artificial Sequence: Synthetic peptide
  XENP024352 vlCDR3
QQANSFPWT

SEQ ID NO: 28848 - protein, 254 aa, Artificial Sequence
  Description of Artificial Sequence: Synthetic polypeptide
  scFV ofXENP024352
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGS

SEQ ID NO: 28849 - protein, 20 aa, Artificial Sequence
  Description of Artificial Sequence: Synthetic peptide
  XENP024352scFv linker
GKPGSGKPGSGKPGSGKPGS

SEQ ID NO: 28850 - protein, 125 aa, Artificial Sequence; identical to SEQ ID NO: 26293
  Description of Artificial Sequence: Synthetic polypeptide
  VH of XENP024353

SEQ ID NO: 28851 - protein, 5 aa, Artificial Sequence
  Description of Artificial Sequence: Synthetic peptide
  XENP024353 vhCDR1
GYYMH

SEQ ID NO: 28852 - protein, 17 aa, Artificial Sequence
  Description of Artificial Sequence: Synthetic peptide
  XENP024353 vhCDR2
WINPHSGGTNYAQKFQG

SEQ ID NO: 28853 - protein, 16 aa, Artificial Sequence
  Description of Artificial Sequence: Synthetic peptide
  XENP024353 vhCDR3
TYYYDSSGYYHDAFDI

SEQ ID NO: 28854 - protein, 107 aa, Artificial Sequence; identical to SEQ ID NO: 26298
  Description of Artificial Sequence: Synthetic polypeptide
  VL of XENP024353

SEQ ID NO: 28855 - protein, 11 aa, Artificial Sequence
  Description of Artificial Sequence: Synthetic peptide
  XENP024353 vlCDR1
RASQGISRLLA

SEQ ID NO: 28856 - protein, 7 aa, Artificial Sequence
  Description of Artificial Sequence: Synthetic peptide
  XENP024353 vlCDR2
VASSLQS

SEQ ID NO: 28857 - protein, 9 aa, Artificial Sequence
  Description of Artificial Sequence: Synthetic peptide
  XENP024353 vlCDR3
QQANSFPWT

SEQ ID NO: 28858 - protein, 254 aa, Artificial Sequence
  Description of Artificial Sequence: Synthetic polypeptide
  scFV ofXENP024353
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGS

SEQ ID NO: 28859 - protein, 20 aa, Artificial Sequence
  Description of Artificial Sequence: Synthetic peptide
  XENP024353scFv linker
GKPGSGKPGSGKPGSGKPGS

SEQ ID NO: 28860 - protein, 125 aa, Artificial Sequence
  Description of Artificial Sequence: Synthetic polypeptide
  VH of XENP024354
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS

SEQ ID NO: 28861 - protein, 5 aa, Artificial Sequence
  Description of Artificial Sequence: Synthetic peptide
  XENP024354 vhCDR1
GYYMH

SEQ ID NO: 28862 - protein, 17 aa, Artificial Sequence
  Description of Artificial Sequence: Synthetic peptide
  XENP024354 vhCDR2
WINPHSGETNYAQKFQG

SEQ ID NO: 28863 - protein, 16 aa, Artificial Sequence
  Description of Artificial Sequence: Synthetic peptide
  XENP024354 vhCDR3
TYYYDTSGYYHDAFDV

SEQ ID NO: 28864 - protein, 107 aa, Artificial Sequence
  Description of Artificial Sequence: Synthetic polypeptide
  VL of XENP024354
DIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK

SEQ ID NO: 28865 - protein, 11 aa, Artificial Sequence
  Description of Artificial Sequence: Synthetic peptide
  XENP024354 vlCDR1
RASQDISRLLA

SEQ ID NO: 28866 - protein, 7 aa, Artificial Sequence
  Description of Artificial Sequence: Synthetic peptide
  XENP024354 vlCDR2
AASSLQS

SEQ ID NO: 28867 - protein, 9 aa, Artificial Sequence
  Description of Artificial Sequence: Synthetic peptide
  XENP024354 vlCDR3
QQANSFPWT

SEQ ID NO: 28868 - protein, 254 aa, Artificial Sequence
  Description of Artificial Sequence: Synthetic polypeptide
  scFV of XENP024354
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIKGS

SEQ ID NO: 28869 - protein, 20 aa, Artificial Sequence
  Description of Artificial Sequence: Synthetic peptide
  XENP024354 scFv linker
GKPGSGKPGSGKPGSGKPGS

SEQ ID NO: 28870 - protein, 125 aa, Artificial Sequence; identical to SEQ ID NO: 28860
  Description of Artificial Sequence: Synthetic polypeptide
  VH of XENP024355

SEQ ID NO: 28871 - protein, 5 aa, Artificial Sequence
  Description of Artificial Sequence: Synthetic peptide
  XENP024355 vhCDR1
GYYMH

SEQ ID NO: 28872 - protein, 17 aa, Artificial Sequence
  Description of Artificial Sequence: Synthetic peptide
  XENP024355 vhCDR2
WINPHSGETNYAQKFQG

SEQ ID NO: 28873 - protein, 16 aa, Artificial Sequence
  Description of Artificial Sequence: Synthetic peptide
  XENP024355 vhCDR3
TYYYDTSGYYHDAFDV

SEQ ID NO: 28874 - protein, 107 aa, Artificial Sequence
  Description of Artificial Sequence: Synthetic polypeptide
  VL of XENP024355
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK

SEQ ID NO: 28875 - protein, 11 aa, Artificial Sequence
  Description of Artificial Sequence: Synthetic peptide
  XENP024355 vlCDR1
RASQDISRLLA

SEQ ID NO: 28876 - protein, 7 aa, Artificial Sequence
  Description of Artificial Sequence: Synthetic peptide
  XENP024355 vlCDR2
AASSLQS

SEQ ID NO: 28877 - protein, 9 aa, Artificial Sequence
  Description of Artificial Sequence: Synthetic peptide
  XENP024355 vlCDR3
QQAQSFPWT

SEQ ID NO: 28878 - protein, 254 aa, Artificial Sequence
  Description of Artificial Sequence: Synthetic polypeptide
  scFV ofXENP024355
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGS

SEQ ID NO: 28879 - protein, 20 aa, Artificial Sequence
  Description of Artificial Sequence: Synthetic peptide
  XENP024355scFv linker
GKPGSGKPGSGKPGSGKPGS

SEQ ID NO: 28880 - protein, 125 aa, Artificial Sequence; identical to SEQ ID NO: 26563
  Description of Artificial Sequence: Synthetic polypeptide
  VH of XENP024356

SEQ ID NO: 28881 - protein, 5 aa, Artificial Sequence
  Description of Artificial Sequence: Synthetic peptide
  XENP024356 vhCDR1
GYYMH

SEQ ID NO: 28882 - protein, 17 aa, Artificial Sequence
  Description of Artificial Sequence: Synthetic peptide
  XENP024356 vhCDR2
WINPHSGETIYAQKFQG

SEQ ID NO: 28883 - protein, 16 aa, Artificial Sequence
  Description of Artificial Sequence: Synthetic peptide
  XENP024356 vhCDR3
TYYYDTSGYYHDAFDV

SEQ ID NO: 28884 - protein, 107 aa, Artificial Sequence; identical to SEQ ID NO: 28864
  Description of Artificial Sequence: Synthetic polypeptide
  VL of XENP024356

SEQ ID NO: 28885 - protein, 11 aa, Artificial Sequence
  Description of Artificial Sequence: Synthetic peptide
  XENP024356 vlCDR1
RASQDISRLLA

SEQ ID NO: 28886 - protein, 7 aa, Artificial Sequence
  Description of Artificial Sequence: Synthetic peptide
  XENP024356 vlCDR2
AASSLQS

SEQ ID NO: 28887 - protein, 9 aa, Artificial Sequence
  Description of Artificial Sequence: Synthetic peptide
  XENP024356 vlCDR3
QQANSFPWT

SEQ ID NO: 28888 - protein, 254 aa, Artificial Sequence
  Description of Artificial Sequence: Synthetic polypeptide
  scFV ofXENP024356
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIKGS

SEQ ID NO: 28889 - protein, 20 aa, Artificial Sequence
  Description of Artificial Sequence: Synthetic peptide
  XENP024356scFv linker
GKPGSGKPGSGKPGSGKPGS

SEQ ID NO: 28890 - protein, 125 aa, Artificial Sequence; identical to SEQ ID NO: 26563
  Description of Artificial Sequence: Synthetic polypeptide
  VH of XENP024357

SEQ ID NO: 28891 - protein, 5 aa, Artificial Sequence
  Description of Artificial Sequence: Synthetic peptide
  XENP024357 vhCDR1
GYYMH

SEQ ID NO: 28892 - protein, 17 aa, Artificial Sequence
  Description of Artificial Sequence: Synthetic peptide
  XENP024357 vhCDR2
WINPHSGETIYAQKFQG

SEQ ID NO: 28893 - protein, 16 aa, Artificial Sequence
  Description of Artificial Sequence: Synthetic peptide
  XENP024357 vhCDR3
TYYYDTSGYYHDAFDV

SEQ ID NO: 28894 - protein, 107 aa, Artificial Sequence; identical to SEQ ID NO: 28874
  Description of Artificial Sequence: Synthetic polypeptide
  VL of XENP024357

SEQ ID NO: 28895 - protein, 11 aa, Artificial Sequence
  Description of Artificial Sequence: Synthetic peptide
  XENP024357 vlCDR1
RASQDISRLLA

SEQ ID NO: 28896 - protein, 7 aa, Artificial Sequence
  Description of Artificial Sequence: Synthetic peptide
  XENP024357 vlCDR2
AASSLQS

SEQ ID NO: 28897 - protein, 9 aa, Artificial Sequence
  Description of Artificial Sequence: Synthetic peptide
  XENP024357 vlCDR3
QQAQSFPWT

SEQ ID NO: 28898 - protein, 254 aa, Artificial Sequence
  Description of Artificial Sequence: Synthetic polypeptide
  scFV ofXENP024357
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGS

SEQ ID NO: 28899 - protein, 20 aa, Artificial Sequence
  Description of Artificial Sequence: Synthetic peptide
  XENP024357scFv linker
GKPGSGKPGSGKPGSGKPGS

SEQ ID NO: 28900 - protein, 125 aa, Artificial Sequence; identical to SEQ ID NO: 28860
  Description of Artificial Sequence: Synthetic polypeptide
  VH of XENP024609

SEQ ID NO: 28901 - protein, 5 aa, Artificial Sequence
  Description of Artificial Sequence: Synthetic peptide
  XENP024609 vhCDR1
GYYMH

SEQ ID NO: 28902 - protein, 17 aa, Artificial Sequence
  Description of Artificial Sequence: Synthetic peptide
  XENP024609 vhCDR2
WINPHSGETNYAQKFQG

SEQ ID NO: 28903 - protein, 16 aa, Artificial Sequence
  Description of Artificial Sequence: Synthetic peptide
  XENP024609 vhCDR3
TYYYDTSGYYHDAFDV

SEQ ID NO: 28904 - protein, 107 aa, Artificial Sequence; identical to SEQ ID NO: 28874
  Description of Artificial Sequence: Synthetic polypeptide
  VL of XENP024609

SEQ ID NO: 28905 - protein, 11 aa, Artificial Sequence
  Description of Artificial Sequence: Synthetic peptide
  XENP024609 vlCDR1
RASQDISRLLA

SEQ ID NO: 28906 - protein, 7 aa, Artificial Sequence
  Description of Artificial Sequence: Synthetic peptide
  XENP024609 vlCDR2
AASSLQS

SEQ ID NO: 28907 - protein, 9 aa, Artificial Sequence
  Description of Artificial Sequence: Synthetic peptide
  XENP024609 vlCDR3
QQAQSFPWT

SEQ ID NO: 28908 - protein, 254 aa, Artificial Sequence
  Description of Artificial Sequence: Synthetic polypeptide
  scFV ofXENP024609
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 28909 - protein, 20 aa, Artificial Sequence
  Description of Artificial Sequence: Synthetic peptide
  XENP024609scFv linker
GKPGSGKPGSGKPGSGKPGS

SEQ ID NO: 28910 - protein, 125 aa, Artificial Sequence
  Description of Artificial Sequence: Synthetic polypeptide
  VH of XENP024689
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSS

SEQ ID NO: 28911 - protein, 5 aa, Artificial Sequence
  Description of Artificial Sequence: Synthetic peptide
  XENP024689 vhCDR1
GYYMH

SEQ ID NO: 28912 - protein, 17 aa, Artificial Sequence
  Description of Artificial Sequence: Synthetic peptide
  XENP024689 vhCDR2
WINPHSGGTNYAQKFQG

SEQ ID NO: 28913 - protein, 16 aa, Artificial Sequence
  Description of Artificial Sequence: Synthetic peptide
  XENP024689 vhCDR3
TYYYDTSGYYHDAFDV

SEQ ID NO: 28914 - protein, 107 aa, Artificial Sequence; identical to SEQ ID NO: 28874
  Description of Artificial Sequence: Synthetic polypeptide
  VL of XENP024689

SEQ ID NO: 28915 - protein, 11 aa, Artificial Sequence
  Description of Artificial Sequence: Synthetic peptide
  XENP024689 vlCDR1
RASQDISRLLA

SEQ ID NO: 28916 - protein, 7 aa, Artificial Sequence
  Description of Artificial Sequence: Synthetic peptide
  XENP024689 vlCDR2
AASSLQS

SEQ ID NO: 28917 - protein, 9 aa, Artificial Sequence
  Description of Artificial Sequence: Synthetic peptide
  XENP024689 vlCDR3
QQAQSFPWT

SEQ ID NO: 28918 - protein, 254 aa, Artificial Sequence
  Description of Artificial Sequence: Synthetic polypeptide
  scFV ofXENP024689
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGS

SEQ ID NO: 28919 - protein, 20 aa, Artificial Sequence
  Description of Artificial Sequence: Synthetic peptide
  XENP024689scFv linker
GKPGSGKPGSGKPGSGKPGS

SEQ ID NO: 28920 - protein, 125 aa, Artificial Sequence
  Description of Artificial Sequence: Synthetic polypeptide
  VH of XENP024690
QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSS

SEQ ID NO: 28921 - protein, 5 aa, Artificial Sequence
  Description of Artificial Sequence: Synthetic peptide
  XENP024690 vhCDR1
GYYMH

SEQ ID NO: 28922 - protein, 17 aa, Artificial Sequence
  Description of Artificial Sequence: Synthetic peptide
  XENP024690 vhCDR2
WINPHSGETNYAQKFQG

SEQ ID NO: 28923 - protein, 16 aa, Artificial Sequence
  Description of Artificial Sequence: Synthetic peptide
  XENP024690 vhCDR3
TYYYDTSGYYHDAFDV

SEQ ID NO: 28924 - protein, 107 aa, Artificial Sequence; identical to SEQ ID NO: 28874
  Description of Artificial Sequence: Synthetic polypeptide
  VL of XENP024690

SEQ ID NO: 28925 - protein, 11 aa, Artificial Sequence
  Description of Artificial Sequence: Synthetic peptide
  XENP024690 vlCDR1
RASQDISRLLA

SEQ ID NO: 28926 - protein, 7 aa, Artificial Sequence
  Description of Artificial Sequence: Synthetic peptide
  XENP024690 vlCDR2
AASSLQS

SEQ ID NO: 28927 - protein, 9 aa, Artificial Sequence
  Description of Artificial Sequence: Synthetic peptide
  XENP024690 vlCDR3
QQAQSFPWT

SEQ ID NO: 28928 - protein, 254 aa, Artificial Sequence
  Description of Artificial Sequence: Synthetic polypeptide
  scFV ofXENP024690
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSSGS

SEQ ID NO: 28929 - protein, 20 aa, Artificial Sequence
  Description of Artificial Sequence: Synthetic peptide
  XENP024690scFv linker
GKPGSGKPGSGKPGSGKPGS

SEQ ID NO: 28930 - protein, 125 aa, Artificial Sequence
  Description of Artificial Sequence: Synthetic polypeptide
  VH of XENP024691
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSS

SEQ ID NO: 28931 - protein, 5 aa, Artificial Sequence
  Description of Artificial Sequence: Synthetic peptide
  XENP024691 vhCDR1
GYYMH

SEQ ID NO: 28932 - protein, 17 aa, Artificial Sequence
  Description of Artificial Sequence: Synthetic peptide
  XENP024691 vhCDR2
WINPHSGGTNYAQKFQG

SEQ ID NO: 28933 - protein, 16 aa, Artificial Sequence
  Description of Artificial Sequence: Synthetic peptide
  XENP024691 vhCDR3
TYYYDTSGYYHDAFDV

SEQ ID NO: 28934 - protein, 107 aa, Artificial Sequence; identical to SEQ ID NO: 28874
  Description of Artificial Sequence: Synthetic polypeptide
  VL of XENP024691

SEQ ID NO: 28935 - protein, 11 aa, Artificial Sequence
  Description of Artificial Sequence: Synthetic peptide
  XENP024691 vlCDR1
RASQDISRLLA

SEQ ID NO: 28936 - protein, 7 aa, Artificial Sequence
  Description of Artificial Sequence: Synthetic peptide
  XENP024691 vlCDR2
AASSLQS

SEQ ID NO: 28937 - protein, 9 aa, Artificial Sequence
  Description of Artificial Sequence: Synthetic peptide
  XENP024691 vlCDR3
QQAQSFPWT

SEQ ID NO: 28938 - protein, 254 aa, Artificial Sequence
  Description of Artificial Sequence: Synthetic polypeptide
  scFV ofXENP024691
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGS

SEQ ID NO: 28939 - protein, 20 aa, Artificial Sequence
  Description of Artificial Sequence: Synthetic peptide
  XENP024691scFv linker
GKPGSGKPGSGKPGSGKPGS

SEQ ID NO: 28940 - protein, 125 aa, Artificial Sequence
  Description of Artificial Sequence: Synthetic polypeptide
  VH of XENP024692
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSS

SEQ ID NO: 28941 - protein, 5 aa, Artificial Sequence
  Description of Artificial Sequence: Synthetic peptide
  XENP024692 vhCDR1
GYYMH

SEQ ID NO: 28942 - protein, 17 aa, Artificial Sequence
  Description of Artificial Sequence: Synthetic peptide
  XENP024692 vhCDR2
WINPHSGGTNYAQKFQG

SEQ ID NO: 28943 - protein, 16 aa, Artificial Sequence
  Description of Artificial Sequence: Synthetic peptide
  XENP024692 vhCDR3
TYYYDSSGYYHDAFDV

SEQ ID NO: 28944 - protein, 107 aa, Artificial Sequence; identical to SEQ ID NO: 28874
  Description of Artificial Sequence: Synthetic polypeptide
  VL of XENP024692

SEQ ID NO: 28945 - protein, 11 aa, Artificial Sequence
  Description of Artificial Sequence: Synthetic peptide
  XENP024692 vlCDR1
RASQDISRLLA

SEQ ID NO: 28946 - protein, 7 aa, Artificial Sequence
  Description of Artificial Sequence: Synthetic peptide
  XENP024692 vlCDR2
AASSLQS

SEQ ID NO: 28947 - protein, 9 aa, Artificial Sequence
  Description of Artificial Sequence: Synthetic peptide
  XENP024692 vlCDR3
QQAQSFPWT

SEQ ID NO: 28948 - protein, 254 aa, Artificial Sequence
  Description of Artificial Sequence: Synthetic polypeptide
  scFV ofXENP024692
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSSGS

SEQ ID NO: 28949 - protein, 20 aa, Artificial Sequence
  Description of Artificial Sequence: Synthetic peptide
  XENP024692scFv linker
GKPGSGKPGSGKPGSGKPGS

SEQ ID NO: 28950 - protein, 125 aa, Artificial Sequence; identical to SEQ ID NO: 28860
  Description of Artificial Sequence: Synthetic polypeptide
  VH of XENP024693

SEQ ID NO: 28951 - protein, 5 aa, Artificial Sequence
  Description of Artificial Sequence: Synthetic peptide
  XENP024693 vhCDR1
GYYMH

SEQ ID NO: 28952 - protein, 17 aa, Artificial Sequence
  Description of Artificial Sequence: Synthetic peptide
  XENP024693 vhCDR2
WINPHSGETNYAQKFQG

SEQ ID NO: 28953 - protein, 16 aa, Artificial Sequence
  Description of Artificial Sequence: Synthetic peptide
  XENP024693 vhCDR3
TYYYDTSGYYHDAFDV

SEQ ID NO: 28954 - protein, 107 aa, Artificial Sequence
  Description of Artificial Sequence: Synthetic polypeptide
  VL of XENP024693
DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIK

SEQ ID NO: 28955 - protein, 11 aa, Artificial Sequence
  Description of Artificial Sequence: Synthetic peptide
  XENP024693 vlCDR1
RASQSISRLLA

SEQ ID NO: 28956 - protein, 7 aa, Artificial Sequence
  Description of Artificial Sequence: Synthetic peptide
  XENP024693 vlCDR2
AASSLQS

SEQ ID NO: 28957 - protein, 9 aa, Artificial Sequence
  Description of Artificial Sequence: Synthetic peptide
  XENP024693 vlCDR3
QQAQSFPWT

SEQ ID NO: 28958 - protein, 254 aa, Artificial Sequence
  Description of Artificial Sequence: Synthetic polypeptide
  scFV ofXENP024693
DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 28959 - protein, 20 aa, Artificial Sequence
  Description of Artificial Sequence: Synthetic peptide
  XENP024693scFv linker
GKPGSGKPGSGKPGSGKPGS

SEQ ID NO: 28960 - protein, 125 aa, Artificial Sequence; identical to SEQ ID NO: 28860
  Description of Artificial Sequence: Synthetic polypeptide
  VH of XENP024694

SEQ ID NO: 28961 - protein, 5 aa, Artificial Sequence
  Description of Artificial Sequence: Synthetic peptide
  XENP024694 vhCDR1
GYYMH

SEQ ID NO: 28962 - protein, 17 aa, Artificial Sequence
  Description of Artificial Sequence: Synthetic peptide
  XENP024694 vhCDR2
WINPHSGETNYAQKFQG

SEQ ID NO: 28963 - protein, 16 aa, Artificial Sequence
  Description of Artificial Sequence: Synthetic peptide
  XENP024694 vhCDR3
TYYYDTSGYYHDAFDV

SEQ ID NO: 28964 - protein, 107 aa, Artificial Sequence
  Description of Artificial Sequence: Synthetic polypeptide
  VL of XENP024694
DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIK

SEQ ID NO: 28965 - protein, 11 aa, Artificial Sequence
  Description of Artificial Sequence: Synthetic peptide
  XENP024694 vlCDR1
RASQDISRLLA

SEQ ID NO: 28966 - protein, 7 aa, Artificial Sequence
  Description of Artificial Sequence: Synthetic peptide
  XENP024694 vlCDR2
SASSLQS

SEQ ID NO: 28967 - protein, 9 aa, Artificial Sequence
  Description of Artificial Sequence: Synthetic peptide
  XENP024694 vlCDR3
QQAQSFPWT

SEQ ID NO: 28968 - protein, 254 aa, Artificial Sequence
  Description of Artificial Sequence: Synthetic polypeptide
  scFV ofXENP024694
DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 28969 - protein, 20 aa, Artificial Sequence
  Description of Artificial Sequence: Synthetic peptide
  XENP024694scFv linker
GKPGSGKPGSGKPGSGKPGS

SEQ ID NO: 28970 - protein, 329 aa, Artificial Sequence; identical to SEQ ID NO: 28669
  Description of Artificial Sequence: Synthetic polypeptide
  Fab-Fc Heavy chain

SEQ ID NO: 28971 - protein, 113 aa, Artificial Sequence; identical to SEQ ID NO: 26849
  Description of Artificial Sequence: Synthetic polypeptide
  Fab-scFv-Fc Heavy chain

SEQ ID NO: 28972 - protein, 235 aa, Artificial Sequence
  Description of Artificial Sequence: Synthetic polypeptide
  Fab-scFv-Fc Heavy chain
GGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28973 - protein, 107 aa, Artificial Sequence [sequence omitted]

SEQ ID NO: 28974 - protein, 113 aa, Artificial Sequence; identical to SEQ ID NO: 26907
  Description of Artificial Sequence: Synthetic polypeptide
  Heavy chain

SEQ ID NO: 28975 - protein, 235 aa, Artificial Sequence
  Description of Artificial Sequence: Synthetic polypeptide
  Heavy chain
GGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28976 - protein, 107 aa, Artificial Sequence [sequence omitted]

SEQ ID NO: 28977 - protein, 329 aa, Artificial Sequence; identical to SEQ ID NO: 28669
  Description of Artificial Sequence: Synthetic polypeptide
  Heavy chain 1

SEQ ID NO: 28978 - protein, 329 aa, Artificial Sequence
  Description of Artificial Sequence: Synthetic polypeptide
  Heavy chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28979 - protein, 107 aa, Artificial Sequence [sequence omitted]

SEQ ID NO: 28980 - protein, 107 aa, Artificial Sequence [sequence omitted]

SEQ ID NO: 28981 - protein, 13 aa, Artificial Sequence
  Description of Artificial Sequence: Synthetic peptide
  Heavy chain
ASTKGPSVFPLAP

SEQ ID NO: 28982 - protein, 329 aa, Artificial Sequence; identical to SEQ ID NO: 26960
  Description of Artificial Sequence: Synthetic polypeptide
  Heavy chain

SEQ ID NO: 28983 - protein, 13 aa, Artificial Sequence
  Description of Artificial Sequence: Synthetic peptide
  Light chain
RTVAAPSVFIFPP

SEQ ID NO: 28984 - protein, 107 aa, Artificial Sequence [sequence omitted]

SEQ ID NO: 28985 - protein, 8 aa, Artificial Sequence
  Description of Artificial Sequence: Synthetic peptide
  Heavy chain 1
GGGSGGGG

SEQ ID NO: 28986 - protein, 265 aa, Artificial Sequence; identical to SEQ ID NO: 26980
  Description of Artificial Sequence: Synthetic polypeptide
  Heavy chain 1

SEQ ID NO: 28987 - protein, 329 aa, Artificial Sequence; identical to SEQ ID NO: 28978
  Description of Artificial Sequence: Synthetic polypeptide
  Heavy chain 2

SEQ ID NO: 28988 - protein, 8 aa, Artificial Sequence
  Description of Artificial Sequence: Synthetic peptide
  Light chain 1
GGGSGGGG

SEQ ID NO: 28989 - protein, 34 aa, Artificial Sequence; identical to SEQ ID NO: 26995
  Description of Artificial Sequence: Synthetic polypeptide
  Light chain 1

SEQ ID NO: 28990 - protein, 107 aa, Artificial Sequence [sequence omitted]

SEQ ID NO: 28991 - protein, 329 aa, Artificial Sequence; identical to SEQ ID NO: 28669
  Description of Artificial Sequence: Synthetic polypeptide
  monomer 1 (Fab-scFv side)

SEQ ID NO: 28992 - protein, 329 aa, Artificial Sequence
  Description of Artificial Sequence: Synthetic polypeptide
  monomer 2 (Fab side)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28993 - protein, 107 aa, Artificial Sequence [sequence omitted]

SEQ ID NO: 28994 - protein, 329 aa, Artificial Sequence; identical to SEQ ID NO: 28669
  Description of Artificial Sequence: Synthetic polypeptide
  Fab-scFv-Hc - 356D/358L allotype

SEQ ID NO: 28995 - protein, 329 aa, Artificial Sequence
  Description of Artificial Sequence: Synthetic polypeptide
  mAb-scFv Fab-Hc - 356D/358L allotype
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28996 - protein, 329 aa, Artificial Sequence; identical to SEQ ID NO: 28680
  Description of Artificial Sequence: Synthetic polypeptide
  mAb-scFv Fab-scFv-Hc - N297A

SEQ ID NO: 28997 - protein, 329 aa, Artificial Sequence
  Description of Artificial Sequence: Synthetic polypeptide
  mAb-scFv Fab-Hc - N297A
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28998 - protein, 329 aa, Artificial Sequence; identical to SEQ ID NO: 28682
  Description of Artificial Sequence: Synthetic polypeptide
  mAb-scFv Fab-scFv-Hc - N297S

SEQ ID NO: 28999 - protein, 329 aa, Artificial Sequence
  Description of Artificial Sequence: Synthetic polypeptide
  mAb-scFv Fab-Hc - N297S
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29000 - protein, 327 aa, Artificial Sequence; identical to SEQ ID NO: 28684
  Description of Artificial Sequence: Synthetic polypeptide
  mAb-scFv Fab-scFv-IgG4-Hc

SEQ ID NO: 29001 - protein, 327 aa, Artificial Sequence
  Description of Artificial Sequence: Synthetic polypeptide
  mAb-scFv Fab-IgG4-Hc
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 29002 - protein, 326 aa, Artificial Sequence; identical to SEQ ID NO: 28686
  Description of Artificial Sequence: Synthetic polypeptide
  mAb-scFv Fab-scFv-IgG2-Hc - without S267K

SEQ ID NO: 29003 - protein, 326 aa, Artificial Sequence
  Description of Artificial Sequence: Synthetic polypeptide
  mAb-scFv Fab-IgG2-Hc - without S267K
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29004 - protein, 326 aa, Artificial Sequence; identical to SEQ ID NO: 28688
  Description of Artificial Sequence: Synthetic polypeptide
  mAb-scFv Fab-scFv-IgG2-Hc - with S267K

SEQ ID NO: 29005 - protein, 326 aa, Artificial Sequence
  Description of Artificial Sequence: Synthetic polypeptide
  mAb-scFv Fab-IgG2-Hc - with S267K
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29006 - protein, 120 aa, Artificial Sequence [sequence omitted]

SEQ ID NO: 29007 - protein, 111 aa, Artificial Sequence [sequence omitted]

SEQ ID NO: 29008 - protein, 113 aa, Artificial Sequence [sequence omitted]

SEQ ID NO: 29009 - protein, 107 aa, Artificial Sequence [sequence omitted]

SEQ ID NO: 29010 - protein, 117 aa, Artificial Sequence
  Description of Artificial Sequence: Synthetic polypeptide
  Teva pidilizumab VH
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 29011 - protein, 106 aa, Artificial Sequence
  Description of Artificial Sequence: Synthetic polypeptide
  Teva pidilizumab VL
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 29012 - protein, 120 aa, Artificial Sequence [sequence omitted]

SEQ ID NO: 29013 - protein, 111 aa, Artificial Sequence [sequence omitted]

SEQ ID NO: 29014 - protein, 117 aa, Artificial Sequence
  Description of Artificial Sequence: Synthetic polypeptide
  Novartis/Dana Farber BAP049 clone E VH
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 29015 - protein, 113 aa, Artificial Sequence
  Description of Artificial Sequence: Synthetic polypeptide
  Novartis/Dana Farber BAP049 clone E VL
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 29016 - protein, 117 aa, Artificial Sequence; identical to SEQ ID NO: 29014
  Description of Artificial Sequence: Synthetic polypeptide
  Novartis/Dana Farber BAP049 clone B VH

SEQ ID NO: 29017 - protein, 113 aa, Artificial Sequence
  Description of Artificial Sequence: Synthetic polypeptide
  Novartis/Dana Farber BAP049 clone B VL
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 29018 - protein, 117 aa, Artificial Sequence [sequence omitted]

SEQ ID NO: 29019 - protein, 107 aa, Artificial Sequence [sequence omitted]

SEQ ID NO: 29020 - protein, 122 aa, Artificial Sequence
  Description of Artificial Sequence: Synthetic polypeptide
  Medimmune h1H3 Var 6 VH
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 29021 - protein, 106 aa, Artificial Sequence
  Description of Artificial Sequence: Synthetic polypeptide
  Medimmune h1H3 Var 6 VL
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 29022 - protein, 116 aa, Artificial Sequence
  Description of Artificial Sequence: Synthetic polypeptide
  Tesarao TSR-042/APE2058 VH
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 29023 - protein, 107 aa, Artificial Sequence
  Description of Artificial Sequence: Synthetic polypeptide
  Tesarao TSR-042/APE2058 VL
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 29024 - protein, 116 aa, Artificial Sequence
  Description of Artificial Sequence: Synthetic polypeptide
  Incyte Camrelizumab VH
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 29025 - protein, 107 aa, Artificial Sequence
  Description of Artificial Sequence: Synthetic polypeptide
  Incyte Camrelizumab VL
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 29026 - protein, 118 aa, Artificial Sequence
  Description of Artificial Sequence: Synthetic polypeptide
  Beigene 317-4B6 VH
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 29027 - protein, 107 aa, Artificial Sequence
  Description of Artificial Sequence: Synthetic polypeptide
  Beigene 317-4B6 VL
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 29028 - protein, 114 aa, Artificial Sequence
  Description of Artificial Sequence: Synthetic polypeptide
  Beigene 326-4A3 VH
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 29029 - protein, 110 aa, Artificial Sequence
  Description of Artificial Sequence: Synthetic polypeptide
  Beigene 326-4A3 VL
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 29030 - protein, 119 aa, Artificial Sequence; identical to SEQ ID NO: 27009
  Description of Artificial Sequence: Synthetic polypeptide
  Macrogenics mAb 7 (1.2) VH

SEQ ID NO: 29031 - protein, 111 aa, Artificial Sequence; identical to SEQ ID NO: 27008
  Description of Artificial Sequence: Synthetic polypeptide
  Macrogenics mAb 7 (1.2) VL

SEQ ID NO: 29032 - protein, 125 aa, Artificial Sequence [sequence omitted]

SEQ ID NO: 29033 - protein, 112 aa, Artificial Sequence [sequence omitted]

SEQ ID NO: 29034 - protein, 125 aa, Artificial Sequence
  Description of Artificial Sequence: Synthetic polypeptide
  Junmeng Clone 39 VH
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 29035 - protein, 112 aa, Artificial Sequence [sequence omitted]

SEQ ID NO: 29036 - protein, 125 aa, Artificial Sequence
  Description of Artificial Sequence: Synthetic polypeptide
  Junmeng Clone 41 VH
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 29037 - protein, 112 aa, Artificial Sequence [sequence omitted]

SEQ ID NO: 29038 - protein, 125 aa, Artificial Sequence; identical to SEQ ID NO: 29034
  Description of Artificial Sequence: Synthetic polypeptide
  Junmeng Clone 48 VH

SEQ ID NO: 29039 - protein, 112 aa, Artificial Sequence
  Description of Artificial Sequence: Synthetic polypeptide
  Junmeng Clone 48 VL
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 29040 - protein, 128 aa, Artificial Sequence
  Description of Artificial Sequence: Synthetic polypeptide
  Wyeth PD1-17 VH
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 29041 - protein, 110 aa, Artificial Sequence
  Description of Artificial Sequence: Synthetic polypeptide
  Wyeth PD1-17 VL
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 29042 - protein, 119 aa, Artificial Sequence
  Description of Artificial Sequence: Synthetic polypeptide
  Wyeth PD1-28 VH
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 29043 - protein, 108 aa, Artificial Sequence
  Description of Artificial Sequence: Synthetic polypeptide
  Wyeth PD1-28 VL
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 29044 - protein, 119 aa, Artificial Sequence
  Description of Artificial Sequence: Synthetic polypeptide
  Wyeth PD1-33 VH
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 29045 - protein, 111 aa, Artificial Sequence
  Description of Artificial Sequence: Synthetic polypeptide
  Wyeth PD1-33 VL
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 29046 - protein, 127 aa, Artificial Sequence
  Description of Artificial Sequence: Synthetic polypeptide
  Wyeth PD1-35 VH
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 29047 - protein, 110 aa, Artificial Sequence
  Description of Artificial Sequence: Synthetic polypeptide
  Wyeth PD1-35 VL
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVL

SEQ ID NO: 29048 - protein, 127 aa, Artificial Sequence; identical to SEQ ID NO: 26823
  Description of Artificial Sequence: Synthetic polypeptide
  Wyeth LOPD180 VH

SEQ ID NO: 29049 - protein, 110 aa, Artificial Sequence; identical to SEQ ID NO: 26838
  Description of Artificial Sequence: Synthetic polypeptide
  Wyeth LOPD180 VL

SEQ ID NO: 29050 - protein, 120 aa, Artificial Sequence
  Description of Artificial Sequence: Synthetic polypeptide
  UCB Ab948 VH
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVSS

SEQ ID NO: 29051 - protein, 112 aa, Artificial Sequence
  Description of Artificial Sequence: Synthetic polypeptide
  UCB Ab948 VL
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 29052 - protein, 121 aa, Artificial Sequence
  Description of Artificial Sequence: Synthetic polypeptide
  Dana-Farber EH-12.2h7 VH
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 29053 - protein, 111 aa, Artificial Sequence
  Description of Artificial Sequence: Synthetic polypeptide
  Dana-Farber EH-12.2h7 VH
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 29054 - protein, 119 aa, Artificial Sequence
  Description of Artificial Sequence: Synthetic polypeptide
  Sorrento RG1H10 VH
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 29055 - protein, 111 aa, Artificial Sequence
  Description of Artificial Sequence: Synthetic polypeptide
  Sorrento RG1H10 VL
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 29056 - protein, 119 aa, Artificial Sequence
  Description of Artificial Sequence: Synthetic polypeptide
  Sorrento RG1H10-H2A-22-1S VH
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 29057 - protein, 111 aa, Artificial Sequence; identical to SEQ ID NO: 29055
  Description of Artificial Sequence: Synthetic polypeptide
  Sorrento RG1H10-H2A-22-1S VL

SEQ ID NO: 29058 - protein, 119 aa, Artificial Sequence
  Description of Artificial Sequence: Synthetic polypeptide
  Sorrento RG1H10-H2A-27-2S VH
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 29059 - protein, 111 aa, Artificial Sequence; identical to SEQ ID NO: 29055
  Description of Artificial Sequence: Synthetic polypeptide
  Sorrento RG1H10-H2A-27-2S VL

SEQ ID NO: 29060 - protein, 119 aa, Artificial Sequence
  Description of Artificial Sequence: Synthetic polypeptide
  Sorrento RG1H10-3C VH
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 29061 - protein, 111 aa, Artificial Sequence; identical to SEQ ID NO: 29055
  Description of Artificial Sequence: Synthetic polypeptide
  Sorrento RG1H10-3C VL

SEQ ID NO: 29062 - protein, 118 aa, Artificial Sequence
  Description of Artificial Sequence: Synthetic polypeptide
  Sorrento RG1H10-16C  VH
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 29063 - protein, 111 aa, Artificial Sequence; identical to SEQ ID NO: 29055
  Description of Artificial Sequence: Synthetic polypeptide
  Sorrento RG1H10-16C  VL

SEQ ID NO: 29064 - protein, 119 aa, Artificial Sequence
  Description of Artificial Sequence: Synthetic polypeptide
  Sorrento RG1H10-17C VH
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 29065 - protein, 111 aa, Artificial Sequence; identical to SEQ ID NO: 29055
  Description of Artificial Sequence: Synthetic polypeptide
  Sorrento RG1H10-17C VL

SEQ ID NO: 29066 - protein, 119 aa, Artificial Sequence
  Description of Artificial Sequence: Synthetic polypeptide
  Sorrento RG1H10-19C VH
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 29067 - protein, 111 aa, Artificial Sequence; identical to SEQ ID NO: 29055
  Description of Artificial Sequence: Synthetic polypeptide
  Sorrento RG1H10-19C VL

SEQ ID NO: 29068 - protein, 119 aa, Artificial Sequence
  Description of Artificial Sequence: Synthetic polypeptide
  Sorrento RG1H10-21C VH
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 29069 - protein, 111 aa, Artificial Sequence; identical to SEQ ID NO: 29055
  Description of Artificial Sequence: Synthetic polypeptide
  Sorrento RG1H10-21C VL

SEQ ID NO: 29070 - protein, 119 aa, Artificial Sequence
  Description of Artificial Sequence: Synthetic polypeptide
  Sorrento RG1H10-23C2 VH
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 29071 - protein, 111 aa, Artificial Sequence; identical to SEQ ID NO: 29055
  Description of Artificial Sequence: Synthetic polypeptide
  Sorrento RG1H10-23C2 VL

SEQ ID NO: 29072 - protein, 117 aa, Artificial Sequence
  Description of Artificial Sequence: Synthetic polypeptide
  Rinat mAb 7 VH
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 29073 - protein, 113 aa, Artificial Sequence
  Description of Artificial Sequence: Synthetic polypeptide
  Rinat mAb 7 VL
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 29074 - protein, 124 aa, Artificial Sequence
  Description of Artificial Sequence: Synthetic polypeptide
  Celgene PD1AB-6 VH
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 29075 - protein, 112 aa, Artificial Sequence
  Description of Artificial Sequence: Synthetic polypeptide
  Celgene PD1AB-6 VL
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 29076 - protein, 124 aa, Artificial Sequence; identical to SEQ ID NO: 26313
  Description of Artificial Sequence: Synthetic polypeptide
  GSK 88.2 VH

SEQ ID NO: 29077 - protein, 112 aa, Artificial Sequence; identical to SEQ ID NO: 26318
  Description of Artificial Sequence: Synthetic polypeptide
  GSK 88.2 VL

SEQ ID NO: 29078 - protein, 123 aa, Artificial Sequence; identical to SEQ ID NO: 26303
  Description of Artificial Sequence: Synthetic polypeptide
  GSK 314.8 VH

SEQ ID NO: 29079 - protein, 112 aa, Artificial Sequence; identical to SEQ ID NO: 26308
  Description of Artificial Sequence: Synthetic polypeptide
  GSK 314.8 VL

SEQ ID NO: 29080 - protein, 121 aa, Artificial Sequence; identical to SEQ ID NO: 26343
  Description of Artificial Sequence: Synthetic polypeptide
  GSK H2L5 VH

SEQ ID NO: 29081 - protein, 106 aa, Artificial Sequence; identical to SEQ ID NO: 26348
  Description of Artificial Sequence: Synthetic polypeptide
  GSK H2L5 VL

SEQ ID NO: 29082 - protein, 117 aa, Artificial Sequence; identical to SEQ ID NO: 26353
  Description of Artificial Sequence: Synthetic polypeptide
  Jounce 37A10S713 VH

SEQ ID NO: 29083 - protein, 111 aa, Artificial Sequence; identical to SEQ ID NO: 26358
  Description of Artificial Sequence: Synthetic polypeptide
  Jounce 37A10S713 VL

SEQ ID NO: 29084 - protein, 125 aa, Artificial Sequence; identical to SEQ ID NO: 26293
  Description of Artificial Sequence: Synthetic polypeptide
  Japan Tobacco Jmab-136 VH

SEQ ID NO: 29085 - protein, 107 aa, Artificial Sequence; identical to SEQ ID NO: 26298
  Description of Artificial Sequence: Synthetic polypeptide
  Japan Tobacco Jmab-136 VL

SEQ ID NO: 29086 - protein, 125 aa, Artificial Sequence; identical to SEQ ID NO: 26323
  Description of Artificial Sequence: Synthetic polypeptide
  Japan Tobacco Jmab-138 VH

SEQ ID NO: 29087 - protein, 109 aa, Artificial Sequence; identical to SEQ ID NO: 26328
  Description of Artificial Sequence: Synthetic polypeptide
  Japan Tobacco Jmab-138 VL

SEQ ID NO: 29088 - protein, 125 aa, Artificial Sequence; identical to SEQ ID NO: 26333
  Description of Artificial Sequence: Synthetic polypeptide
  Japan Tobacco Jmab-139 VH

SEQ ID NO: 29089 - protein, 109 aa, Artificial Sequence; identical to SEQ ID NO: 26338
  Description of Artificial Sequence: Synthetic polypeptide
  Japan Tobacco Jmab-139 VL

SEQ ID NO: 29090 - protein, 121 aa, Artificial Sequence; identical to SEQ ID NO: 3961
  Description of Artificial Sequence: Synthetic polypeptide
  AstraZeneca/Celgene/MedImmune 2.14H9 OPT VH

SEQ ID NO: 29091 - protein, 108 aa, Artificial Sequence; identical to SEQ ID NO: 3965
  Description of Artificial Sequence: Synthetic polypeptide
  AstraZeneca/Celgene/MedImmune 2.14H9 OPT VL

SEQ ID NO: 29092 - protein, 118 aa, Artificial Sequence; identical to SEQ ID NO: 3969
  Description of Artificial Sequence: Synthetic polypeptide
  Genentech atezolizumab VH

SEQ ID NO: 29093 - protein, 108 aa, Artificial Sequence; identical to SEQ ID NO: 3973
  Description of Artificial Sequence: Synthetic polypeptide
  Genentech atezolizumab VL

SEQ ID NO: 29094 - protein, 120 aa, Artificial Sequence; identical to SEQ ID NO: 3977
  Description of Artificial Sequence: Synthetic polypeptide
  Merck/Pfizer avelumab VH

SEQ ID NO: 29095 - protein, 110 aa, Artificial Sequence; identical to SEQ ID NO: 3981
  Description of Artificial Sequence: Synthetic polypeptide
  Merck/Pfizer avelumab VL

SEQ ID NO: 29096 - protein, 123 aa, Artificial Sequence; identical to SEQ ID NO: 3985
  Description of Artificial Sequence: Synthetic polypeptide
  Medarex 12A4 VH

SEQ ID NO: 29097 - protein, 106 aa, Artificial Sequence; identical to SEQ ID NO: 3989
  Description of Artificial Sequence: Synthetic polypeptide
  Medarex 12A4 VL

SEQ ID NO: 29098 - protein, 117 aa, Artificial Sequence; identical to SEQ ID NO: 3993
  Description of Artificial Sequence: Synthetic polypeptide
  Medarex 3G10 VH

SEQ ID NO: 29099 - protein, 107 aa, Artificial Sequence; identical to SEQ ID NO: 3997
  Description of Artificial Sequence: Synthetic polypeptide
  Medarex 3G10 VL

SEQ ID NO: 29100 - protein, 118 aa, Artificial Sequence; identical to SEQ ID NO: 4001
  Description of Artificial Sequence: Synthetic polypeptide
  Medarex 10A5 VH

SEQ ID NO: 29101 - protein, 107 aa, Artificial Sequence; identical to SEQ ID NO: 4005
  Description of Artificial Sequence: Synthetic polypeptide
  Medarex 10A5 VL

SEQ ID NO: 29102 - protein, 114 aa, Artificial Sequence; identical to SEQ ID NO: 4009
  Description of Artificial Sequence: Synthetic polypeptide
  Amplimmune/GSK/MedImmune h3D10 Var1 VH

SEQ ID NO: 29103 - protein, 106 aa, Artificial Sequence; identical to SEQ ID NO: 4013
  Description of Artificial Sequence: Synthetic polypeptide
  Amplimmune/GSK/MedImmune h3D10 Var1 VL

SEQ ID NO: 29104 - protein, 114 aa, Artificial Sequence; identical to SEQ ID NO: 4017
  Description of Artificial Sequence: Synthetic polypeptide
  Amplimmune/GSK/MedImmune h3D10 Var2 VH

SEQ ID NO: 29105 - protein, 106 aa, Artificial Sequence; identical to SEQ ID NO: 4021
  Description of Artificial Sequence: Synthetic polypeptide
  Amplimmune/GSK/MedImmune h3D10 Var2 VL

SEQ ID NO: 29106 - protein, 114 aa, Artificial Sequence; identical to SEQ ID NO: 4017
  Description of Artificial Sequence: Synthetic polypeptide
  Amplimmune/GSK/MedImmune h3D10 Var3 VH

SEQ ID NO: 29107 - protein, 106 aa, Artificial Sequence; identical to SEQ ID NO: 4029
  Description of Artificial Sequence: Synthetic polypeptide
  Amplimmune/GSK/MedImmune h3D10 Var3 VL

SEQ ID NO: 29108 - protein, 114 aa, Artificial Sequence; identical to SEQ ID NO: 4033
  Description of Artificial Sequence: Synthetic polypeptide
  Amplimmune/GSK/MedImmune h3D10 Var4 VH

SEQ ID NO: 29109 - protein, 106 aa, Artificial Sequence; identical to SEQ ID NO: 4021
  Description of Artificial Sequence: Synthetic polypeptide
  Amplimmune/GSK/MedImmune h3D10 Var4 VL

SEQ ID NO: 29110 - protein, 114 aa, Artificial Sequence; identical to SEQ ID NO: 4073
  Description of Artificial Sequence: Synthetic polypeptide
  Amplimmune/GSK/MedImmune h3D10 Var5 VH

SEQ ID NO: 29111 - protein, 106 aa, Artificial Sequence; identical to SEQ ID NO: 4069
  Description of Artificial Sequence: Synthetic polypeptide
  Amplimmune/GSK/MedImmune h3D10 Var5 VL

SEQ ID NO: 29112 - protein, 114 aa, Artificial Sequence; identical to SEQ ID NO: 4049
  Description of Artificial Sequence: Synthetic polypeptide
  Amplimmune/GSK/MedImmune h3D10 Var6 VH

SEQ ID NO: 29113 - protein, 106 aa, Artificial Sequence; identical to SEQ ID NO: 4013
  Description of Artificial Sequence: Synthetic polypeptide
  Amplimmune/GSK/MedImmune h3D10 Var6 VL

SEQ ID NO: 29114 - protein, 114 aa, Artificial Sequence; identical to SEQ ID NO: 4009
  Description of Artificial Sequence: Synthetic polypeptide
  Amplimmune/GSK/MedImmune h3D10 Var7 VH

SEQ ID NO: 29115 - protein, 106 aa, Artificial Sequence; identical to SEQ ID NO: 4053
  Description of Artificial Sequence: Synthetic polypeptide
  Amplimmune/GSK/MedImmune h3D10 Var7 VL

SEQ ID NO: 29116 - protein, 114 aa, Artificial Sequence; identical to SEQ ID NO: 4073
  Description of Artificial Sequence: Synthetic polypeptide
  Amplimmune/GSK/MedImmune h3D10 Var8 VH

SEQ ID NO: 29117 - protein, 106 aa, Artificial Sequence; identical to SEQ ID NO: 4029
  Description of Artificial Sequence: Synthetic polypeptide
  Amplimmune/GSK/MedImmune h3D10 Var8 VL

SEQ ID NO: 29118 - protein, 114 aa, Artificial Sequence; identical to SEQ ID NO: 4073
  Description of Artificial Sequence: Synthetic polypeptide
  Amplimmune/GSK/MedImmune h3D10 Var9 VH

SEQ ID NO: 29119 - protein, 106 aa, Artificial Sequence; identical to SEQ ID NO: 4061
  Description of Artificial Sequence: Synthetic polypeptide
  Amplimmune/GSK/MedImmune h3D10 Var9 VL

SEQ ID NO: 29120 - protein, 114 aa, Artificial Sequence; identical to SEQ ID NO: 4073
  Description of Artificial Sequence: Synthetic polypeptide
  Amplimmune/GSK/MedImmune h3D10 Var10 VH

SEQ ID NO: 29121 - protein, 106 aa, Artificial Sequence; identical to SEQ ID NO: 4069
  Description of Artificial Sequence: Synthetic polypeptide
  Amplimmune/GSK/MedImmune h3D10 Var10 VL

SEQ ID NO: 29122 - protein, 114 aa, Artificial Sequence; identical to SEQ ID NO: 4049
  Description of Artificial Sequence: Synthetic polypeptide
  Amplimmune/GSK/MedImmune h3D10 Var11 VH

SEQ ID NO: 29123 - protein, 106 aa, Artificial Sequence; identical to SEQ ID NO: 4013
  Description of Artificial Sequence: Synthetic polypeptide
  Amplimmune/GSK/MedImmune h3D10 Var11 VL

SEQ ID NO: 29124 - protein, 114 aa, Artificial Sequence; identical to SEQ ID NO: 4009
  Description of Artificial Sequence: Synthetic polypeptide
  Amplimmune/GSK/MedImmune h3D10 Var12 VH

SEQ ID NO: 29125 - protein, 106 aa, Artificial Sequence; identical to SEQ ID NO: 4053
  Description of Artificial Sequence: Synthetic polypeptide
  Amplimmune/GSK/MedImmune h3D10 Var12 VL

SEQ ID NO: 29126 - protein, 114 aa, Artificial Sequence; identical to SEQ ID NO: 4073
  Description of Artificial Sequence: Synthetic polypeptide
  Amplimmune/GSK/MedImmune h3D10 Var13 VH

SEQ ID NO: 29127 - protein, 106 aa, Artificial Sequence; identical to SEQ ID NO: 4029
  Description of Artificial Sequence: Synthetic polypeptide
  Amplimmune/GSK/MedImmune h3D10 Var13 VL

SEQ ID NO: 29128 - protein, 114 aa, Artificial Sequence; identical to SEQ ID NO: 4033
  Description of Artificial Sequence: Synthetic polypeptide
  Amplimmune/GSK/MedImmune h3D10 Var14 VH

SEQ ID NO: 29129 - protein, 106 aa, Artificial Sequence; identical to SEQ ID NO: 4069
  Description of Artificial Sequence: Synthetic polypeptide
  Amplimmune/GSK/MedImmune h3D10 Var14 VL

SEQ ID NO: 29130 - protein, 123 aa, Artificial Sequence; identical to SEQ ID NO: 4121
  Description of Artificial Sequence: Synthetic polypeptide
  Eli Lily Antibody A VH

SEQ ID NO: 29131 - protein, 111 aa, Artificial Sequence; identical to SEQ ID NO: 4125
  Description of Artificial Sequence: Synthetic polypeptide
  Eli Lily Antibody A VL

SEQ ID NO: 29132 - protein, 116 aa, Artificial Sequence; identical to SEQ ID NO: 4129
  Description of Artificial Sequence: Synthetic polypeptide
  Cytomyx C5H9v2 VH

SEQ ID NO: 29133 - protein, 108 aa, Artificial Sequence
  Description of Artificial Sequence: Synthetic polypeptide
  Cytomyx C5H9v2 VL
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 29134 - protein, 94 aa, Artificial Sequence
  Description of Artificial Sequence: Synthetic polypeptide
  Dana-Farber/Novartis Humanized 29E.2A3 VH
CKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 29135 - protein, 111 aa, Artificial Sequence; identical to SEQ ID NO: 4141
  Description of Artificial Sequence: Synthetic polypeptide
  Dana-Farber/Novartis Humanized 29E.2A3 VL

SEQ ID NO: 29136 - protein, 121 aa, Artificial Sequence; identical to SEQ ID NO: 4145
  Description of Artificial Sequence: Synthetic polypeptide
  Dana-Farber/Novartis 1B9 VH

SEQ ID NO: 29137 - protein, 107 aa, Artificial Sequence; identical to SEQ ID NO: 4149
  Description of Artificial Sequence: Synthetic polypeptide
  Dana-Farber/Novartis 1B9 VL

SEQ ID NO: 29138 - protein, 121 aa, Artificial Sequence; identical to SEQ ID NO: 4153
  Description of Artificial Sequence: Synthetic polypeptide
  Dana-Farber/Novartis 4H1 VH

SEQ ID NO: 29139 - protein, 107 aa, Artificial Sequence; identical to SEQ ID NO: 4157
  Description of Artificial Sequence: Synthetic polypeptide
  Dana-Farber/Novartis 4H1 VL

SEQ ID NO: 29140 - protein, 120 aa, Artificial Sequence; identical to SEQ ID NO: 4161
  Description of Artificial Sequence: Synthetic polypeptide
  Dana-Farber/Novartis mAb-42 VH

SEQ ID NO: 29141 - protein, 112 aa, Artificial Sequence; identical to SEQ ID NO: 4165
  Description of Artificial Sequence: Synthetic polypeptide
  Dana-Farber/Novartis mAb-42 VL

SEQ ID NO: 29142 - protein, 120 aa, Artificial Sequence; identical to SEQ ID NO: 4169
  Description of Artificial Sequence: Synthetic polypeptide
  Dana-Farber/Novartis BAP058-03 VH

SEQ ID NO: 29143 - protein, 107 aa, Artificial Sequence; identical to SEQ ID NO: 4173
  Description of Artificial Sequence: Synthetic polypeptide
  Dana-Farber/Novartis BAP058-03 VL

SEQ ID NO: 29144 - protein, 120 aa, Artificial Sequence; identical to SEQ ID NO: 4177
  Description of Artificial Sequence: Synthetic polypeptide
  Dana-Farber/Novartis BAP058-04 VH

SEQ ID NO: 29145 - protein, 107 aa, Artificial Sequence; identical to SEQ ID NO: 4181
  Description of Artificial Sequence: Synthetic polypeptide
  Dana-Farber/Novartis BAP058-04 VL

SEQ ID NO: 29146 - protein, 120 aa, Artificial Sequence; identical to SEQ ID NO: 4185
  Description of Artificial Sequence: Synthetic polypeptide
  Dana-Farber/Novartis BAP058-06 VH

SEQ ID NO: 29147 - protein, 107 aa, Artificial Sequence; identical to SEQ ID NO: 4181
  Description of Artificial Sequence: Synthetic polypeptide
  Dana-Farber/Novartis BAP058-06 VL

SEQ ID NO: 29148 - protein, 120 aa, Artificial Sequence; identical to SEQ ID NO: 4193
  Description of Artificial Sequence: Synthetic polypeptide
  Dana-Farber/Novartis BAP058-07 VH

SEQ ID NO: 29149 - protein, 107 aa, Artificial Sequence; identical to SEQ ID NO: 4197
  Description of Artificial Sequence: Synthetic polypeptide
  Dana-Farber/Novartis BAP058-07 VL

SEQ ID NO: 29150 - protein, 120 aa, Artificial Sequence; identical to SEQ ID NO: 4169
  Description of Artificial Sequence: Synthetic polypeptide
  Dana-Farber/Novartis BAP058-11 VH

SEQ ID NO: 29151 - protein, 107 aa, Artificial Sequence; identical to SEQ ID NO: 4205
  Description of Artificial Sequence: Synthetic polypeptide
  Dana-Farber/Novartis BAP058-11 VL

SEQ ID NO: 29152 - protein, 120 aa, Artificial Sequence; identical to SEQ ID NO: 4209
  Description of Artificial Sequence: Synthetic polypeptide
  Dana-Farber/Novartis BAP058-13 VH

SEQ ID NO: 29153 - protein, 107 aa, Artificial Sequence; identical to SEQ ID NO: 4213
  Description of Artificial Sequence: Synthetic polypeptide
  Dana-Farber/Novartis BAP058-13 VL

SEQ ID NO: 29154 - protein, 121 aa, Artificial Sequence; identical to SEQ ID NO: 4217
  Description of Artificial Sequence: Synthetic polypeptide
  Sorrento H6 VH

SEQ ID NO: 29155 - protein, 108 aa, Artificial Sequence; identical to SEQ ID NO: 4221
  Description of Artificial Sequence: Synthetic polypeptide
  Sorrento H6 VL

SEQ ID NO: 29156 - protein, 121 aa, Artificial Sequence; identical to SEQ ID NO: 4225
  Description of Artificial Sequence: Synthetic polypeptide
  Sorrento RC5 VH

SEQ ID NO: 29157 - protein, 107 aa, Artificial Sequence; identical to SEQ ID NO: 4229
  Description of Artificial Sequence: Synthetic polypeptide
  Sorrento RC5 VL

SEQ ID NO: 29158 - protein, 123 aa, Artificial Sequence; identical to SEQ ID NO: 4233
  Description of Artificial Sequence: Synthetic polypeptide
  Sorrento SH1A1Q VH

SEQ ID NO: 29159 - protein, 110 aa, Artificial Sequence; identical to SEQ ID NO: 4237
  Description of Artificial Sequence: Synthetic polypeptide
  Sorrento SH1A1Q VL

SEQ ID NO: 29160 - protein, 118 aa, Artificial Sequence; identical to SEQ ID NO: 4241
  Description of Artificial Sequence: Synthetic polypeptide
  Sorrento SH1B3 VH

SEQ ID NO: 29161 - protein, 110 aa, Artificial Sequence; identical to SEQ ID NO: 4245
  Description of Artificial Sequence: Synthetic polypeptide
  Sorrento SH1B3 VL

SEQ ID NO: 29162 - protein, 118 aa, Artificial Sequence; identical to SEQ ID NO: 4249
  Description of Artificial Sequence: Synthetic polypeptide
  Sorrento SH1D1 VH

SEQ ID NO: 29163 - protein, 111 aa, Artificial Sequence; identical to SEQ ID NO: 4253
  Description of Artificial Sequence: Synthetic polypeptide
  Sorrento SH1D1 VL

SEQ ID NO: 29164 - protein, 118 aa, Artificial Sequence; identical to SEQ ID NO: 4241
  Description of Artificial Sequence: Synthetic polypeptide
  Sorrento SH1D2 VH

SEQ ID NO: 29165 - protein, 110 aa, Artificial Sequence; identical to SEQ ID NO: 4261
  Description of Artificial Sequence: Synthetic polypeptide
  Sorrento SH1D2 VL

SEQ ID NO: 29166 - protein, 118 aa, Artificial Sequence; identical to SEQ ID NO: 4249
  Description of Artificial Sequence: Synthetic polypeptide
  Sorrento SH1D12 VH

SEQ ID NO: 29167 - protein, 110 aa, Artificial Sequence; identical to SEQ ID NO: 4269
  Description of Artificial Sequence: Synthetic polypeptide
  Sorrento SH1D12 VL

SEQ ID NO: 29168 - protein, 118 aa, Artificial Sequence; identical to SEQ ID NO: 4249
  Description of Artificial Sequence: Synthetic polypeptide
  Sorrento SH1E1 VH

SEQ ID NO: 29169 - protein, 110 aa, Artificial Sequence; identical to SEQ ID NO: 4277
  Description of Artificial Sequence: Synthetic polypeptide
  Sorrento SH1E1 VL

SEQ ID NO: 29170 - protein, 118 aa, Artificial Sequence; identical to SEQ ID NO: 4241
  Description of Artificial Sequence: Synthetic polypeptide
  Sorrento SH1G9 VH

SEQ ID NO: 29171 - protein, 112 aa, Artificial Sequence; identical to SEQ ID NO: 4285
  Description of Artificial Sequence: Synthetic polypeptide
  Sorrento SH1G9 VL

SEQ ID NO: 29172 - protein, 120 aa, Artificial Sequence; identical to SEQ ID NO: 4289
  Description of Artificial Sequence: Synthetic polypeptide
  Sorrento SH1E6 VH

SEQ ID NO: 29173 - protein, 110 aa, Artificial Sequence; identical to SEQ ID NO: 4293
  Description of Artificial Sequence: Synthetic polypeptide
  Sorrento SH1E6 VL

SEQ ID NO: 29174 - protein, 118 aa, Artificial Sequence; identical to SEQ ID NO: 4297
  Description of Artificial Sequence: Synthetic polypeptide
  Sorrento SH1A2 VH

SEQ ID NO: 29175 - protein, 110 aa, Artificial Sequence; identical to SEQ ID NO: 4301
  Description of Artificial Sequence: Synthetic polypeptide
  Sorrento SH1A2 VL

SEQ ID NO: 29176 - protein, 118 aa, Artificial Sequence; identical to SEQ ID NO: 4305
  Description of Artificial Sequence: Synthetic polypeptide
  Sorrento SH1B1 VH

SEQ ID NO: 29177 - protein, 112 aa, Artificial Sequence; identical to SEQ ID NO: 4309
  Description of Artificial Sequence: Synthetic polypeptide
  Sorrento SH1B1 VL

SEQ ID NO: 29178 - protein, 121 aa, Artificial Sequence; identical to SEQ ID NO: 4313
  Description of Artificial Sequence: Synthetic polypeptide
  Sorrento H6B1L VH

SEQ ID NO: 29179 - protein, 108 aa, Artificial Sequence; identical to SEQ ID NO: 4317
  Description of Artificial Sequence: Synthetic polypeptide
  Sorrento H6B1L VL

SEQ ID NO: 29180 - protein, 121 aa, Artificial Sequence; identical to SEQ ID NO: 4321
  Description of Artificial Sequence: Synthetic polypeptide
  Sorrento H6A1 VH

SEQ ID NO: 29181 - protein, 108 aa, Artificial Sequence; identical to SEQ ID NO: 4221
  Description of Artificial Sequence: Synthetic polypeptide
  Sorrento H6A1 VL

SEQ ID NO: 29182 - protein, 121 aa, Artificial Sequence; identical to SEQ ID NO: 4313
  Description of Artificial Sequence: Synthetic polypeptide
  Sorrento H6B1 VH

SEQ ID NO: 29183 - protein, 108 aa, Artificial Sequence; identical to SEQ ID NO: 4221
  Description of Artificial Sequence: Synthetic polypeptide
  Sorrento H6B1 VL

SEQ ID NO: 29184 - protein, 121 aa, Artificial Sequence; identical to SEQ ID NO: 4337
  Description of Artificial Sequence: Synthetic polypeptide
  Sorrento H6B2 VH

SEQ ID NO: 29185 - protein, 108 aa, Artificial Sequence; identical to SEQ ID NO: 4221
  Description of Artificial Sequence: Synthetic polypeptide
  Sorrento H6B2 VL

SEQ ID NO: 29186 - protein, 118 aa, Artificial Sequence; identical to SEQ ID NO: 4345
  Description of Artificial Sequence: Synthetic polypeptide
  Sorrento G12 VH

SEQ ID NO: 29187 - protein, 107 aa, Artificial Sequence; identical to SEQ ID NO: 4349
  Description of Artificial Sequence: Synthetic polypeptide
  Sorrento G12 VL

SEQ ID NO: 29188 - protein, 118 aa, Artificial Sequence; identical to SEQ ID NO: 4353
  Description of Artificial Sequence: Synthetic polypeptide
  Sorrento RSA1 VH

SEQ ID NO: 29189 - protein, 108 aa, Artificial Sequence; identical to SEQ ID NO: 4357
  Description of Artificial Sequence: Synthetic polypeptide
  Sorrento RSA1 VL

SEQ ID NO: 29190 - protein, 120 aa, Artificial Sequence; identical to SEQ ID NO: 4361
  Description of Artificial Sequence: Synthetic polypeptide
  Sorrento RA3 VH

SEQ ID NO: 29191 - protein, 107 aa, Artificial Sequence; identical to SEQ ID NO: 4365
  Description of Artificial Sequence: Synthetic polypeptide
  Sorrento RA3 VL

SEQ ID NO: 29192 - protein, 119 aa, Artificial Sequence; identical to SEQ ID NO: 4369
  Description of Artificial Sequence: Synthetic polypeptide
  Sorrento SH1E2 VH

SEQ ID NO: 29193 - protein, 109 aa, Artificial Sequence; identical to SEQ ID NO: 4373
  Description of Artificial Sequence: Synthetic polypeptide
  Sorrento SH1E2 VL

SEQ ID NO: 29194 - protein, 120 aa, Artificial Sequence; identical to SEQ ID NO: 4289
  Description of Artificial Sequence: Synthetic polypeptide
  Sorrento SH1E4 VH

SEQ ID NO: 29195 - protein, 112 aa, Artificial Sequence; identical to SEQ ID NO: 4381
  Description of Artificial Sequence: Synthetic polypeptide
  Sorrento SH1E4 VL

SEQ ID NO: 29196 - protein, 121 aa, Artificial Sequence; identical to SEQ ID NO: 4385
  Description of Artificial Sequence: Synthetic polypeptide
  Sorrento SH1B11 VH

SEQ ID NO: 29197 - protein, 107 aa, Artificial Sequence; identical to SEQ ID NO: 4389
  Description of Artificial Sequence: Synthetic polypeptide
  Sorrento SH1B11 VL

SEQ ID NO: 29198 - protein, 119 aa, Artificial Sequence; identical to SEQ ID NO: 4393
  Description of Artificial Sequence: Synthetic polypeptide
  Sorrento SH1C8 VH

SEQ ID NO: 29199 - protein, 111 aa, Artificial Sequence; identical to SEQ ID NO: 4397
  Description of Artificial Sequence: Synthetic polypeptide
  Sorrento SH1C8 VL

SEQ ID NO: 29200 - protein, 123 aa, Artificial Sequence; identical to SEQ ID NO: 4401
  Description of Artificial Sequence: Synthetic polypeptide
  Regeneron H1H9364P2 VH

SEQ ID NO: 29201 - protein, 108 aa, Artificial Sequence; identical to SEQ ID NO: 4405
  Description of Artificial Sequence: Synthetic polypeptide
  Regeneron H1H9364P2 VL

SEQ ID NO: 29202 - protein, 120 aa, Artificial Sequence; identical to SEQ ID NO: 4409
  Description of Artificial Sequence: Synthetic polypeptide
  Regeneron H1H9373P2 VH

SEQ ID NO: 29203 - protein, 108 aa, Artificial Sequence; identical to SEQ ID NO: 4405
  Description of Artificial Sequence: Synthetic polypeptide
  Regeneron H1H9373P2 VL

SEQ ID NO: 29204 - protein, 120 aa, Artificial Sequence; identical to SEQ ID NO: 4417
  Description of Artificial Sequence: Synthetic polypeptide
  Regeneron H1H8314N VH

SEQ ID NO: 29205 - protein, 108 aa, Artificial Sequence; identical to SEQ ID NO: 4421
  Description of Artificial Sequence: Synthetic polypeptide
  Regeneron H1H8314N VL

SEQ ID NO: 29206 - protein, 119 aa, Artificial Sequence; identical to SEQ ID NO: 4425
  Description of Artificial Sequence: Synthetic polypeptide
  Inserm PDL1.3.1 VH

SEQ ID NO: 29207 - protein, 106 aa, Artificial Sequence; identical to SEQ ID NO: 4429
  Description of Artificial Sequence: Synthetic polypeptide
  Inserm PDL1.3.1 VL

SEQ ID NO: 29208 - protein, 118 aa, Artificial Sequence; identical to SEQ ID NO: 3737
  Description of Artificial Sequence: Synthetic polypeptide
  Medarex Ipilimumab VH

SEQ ID NO: 29209 - protein, 108 aa, Artificial Sequence; identical to SEQ ID NO: 3741
  Description of Artificial Sequence: Synthetic polypeptide
  Medarex Ipilimumab VL

SEQ ID NO: 29210 - protein, 125 aa, Artificial Sequence; identical to SEQ ID NO: 3745
  Description of Artificial Sequence: Synthetic polypeptide
  Amgen/MedImmune/Pfizer Tremelimumab VH

SEQ ID NO: 29211 - protein, 107 aa, Artificial Sequence; identical to SEQ ID NO: 3749
  Description of Artificial Sequence: Synthetic polypeptide
  Amgen/MedImmune/Pfizer Tremelimumab VL

SEQ ID NO: 29212 - protein, 118 aa, Artificial Sequence; identical to SEQ ID NO: 3753
  Description of Artificial Sequence: Synthetic polypeptide
  Agenus AGEN1884 VH

SEQ ID NO: 29213 - protein, 107 aa, Artificial Sequence; identical to SEQ ID NO: 3757
  Description of Artificial Sequence: Synthetic polypeptide
  Agenus AGEN1884 VL

SEQ ID NO: 29214 - protein, 116 aa, Artificial Sequence; identical to SEQ ID NO: 3761
  Description of Artificial Sequence: Synthetic polypeptide
  Tegenero 4.3F6B5 VH

SEQ ID NO: 29215 - protein, 107 aa, Artificial Sequence
  Description of Artificial Sequence: Synthetic polypeptide
  Tegenero 4.3F6B5 VL
DILMTQSPASLSASVGETVTITCGASENIYGALNWYQRKQGKSPQLLIYGATNLADGMSSRFSGSGLGRQYYLKISSLHPDDVATYFCQNILGTWTFGGGTKLEIKR

SEQ ID NO: 29216 - protein, 117 aa, Artificial Sequence; identical to SEQ ID NO: 3769
  Description of Artificial Sequence: Synthetic polypeptide
  Tegenero 4.8H10H5 VH

SEQ ID NO: 29217 - protein, 109 aa, Artificial Sequence
  Description of Artificial Sequence: Synthetic polypeptide
  Tegenero 4.8H10H5 VL
ENVLTQSPAIMSASPGERVTMTCSASSSVSYMHWYQQKSNTSPKLWIYDTSKLASGVPGRFSGSGSRNSYSLTISSMEAEDVATYYCFPGSGFPFMYTFGGGTKLEIKR

SEQ ID NO: 29218 - protein, 116 aa, Artificial Sequence; identical to SEQ ID NO: 3777
  Description of Artificial Sequence: Synthetic polypeptide
  Tegenero TGN2122.C VH

SEQ ID NO: 29219 - protein, 106 aa, Artificial Sequence; identical to SEQ ID NO: 3781
  Description of Artificial Sequence: Synthetic polypeptide
  Tegenero TGN2122.C VL

SEQ ID NO: 29220 - protein, 117 aa, Artificial Sequence; identical to SEQ ID NO: 3785
  Description of Artificial Sequence: Synthetic polypeptide
  Tegenero TGN2122.H VH

SEQ ID NO: 29221 - protein, 108 aa, Artificial Sequence; identical to SEQ ID NO: 3789
  Description of Artificial Sequence: Synthetic polypeptide
  Tegenero TGN2122.H VL

SEQ ID NO: 29222 - protein, 123 aa, Artificial Sequence; identical to SEQ ID NO: 3793
  Description of Artificial Sequence: Synthetic polypeptide
  Sorrento F7 VH

SEQ ID NO: 29223 - protein, 107 aa, Artificial Sequence; identical to SEQ ID NO: 3797
  Description of Artificial Sequence: Synthetic polypeptide
  Sorrento F7 VL

SEQ ID NO: 29224 - protein, 121 aa, Artificial Sequence; identical to SEQ ID NO: 3801
  Description of Artificial Sequence: Synthetic polypeptide
  Sorrento E8 VH

SEQ ID NO: 29225 - protein, 107 aa, Artificial Sequence; identical to SEQ ID NO: 3805
  Description of Artificial Sequence: Synthetic polypeptide
  Sorrento E8 VL

SEQ ID NO: 29226 - protein, 114 aa, Artificial Sequence; identical to SEQ ID NO: 3809
  Description of Artificial Sequence: Synthetic polypeptide
  Sorrento CT1E1 VH

SEQ ID NO: 29227 - protein, 108 aa, Artificial Sequence; identical to SEQ ID NO: 3813
  Description of Artificial Sequence: Synthetic polypeptide
  Sorrento CT1E1 VL

SEQ ID NO: 29228 - protein, 120 aa, Artificial Sequence; identical to SEQ ID NO: 3817
  Description of Artificial Sequence: Synthetic polypeptide
  Medarex BMS-986016 VH

SEQ ID NO: 29229 - protein, 107 aa, Artificial Sequence; identical to SEQ ID NO: 3821
  Description of Artificial Sequence: Synthetic polypeptide
  Medarex BMS-986016 VL

SEQ ID NO: 29230 - protein, 116 aa, Artificial Sequence; identical to SEQ ID NO: 3825
  Description of Artificial Sequence: Synthetic polypeptide
  Immutep/INSERM/Novartis IMP731 VH

SEQ ID NO: 29231 - protein, 113 aa, Artificial Sequence; identical to SEQ ID NO: 3829
  Description of Artificial Sequence: Synthetic polypeptide
  Immutep/INSERM/Novartis IMP731 VH

SEQ ID NO: 29232 - protein, 123 aa, Artificial Sequence; identical to SEQ ID NO: 3833
  Description of Artificial Sequence: Synthetic polypeptide
  Immutep/INSERM/Novartis 13E2 VH

SEQ ID NO: 29233 - protein, 107 aa, Artificial Sequence; identical to SEQ ID NO: 3837
  Description of Artificial Sequence: Synthetic polypeptide
  Immutep/INSERM/Novartis 13E2 VH

SEQ ID NO: 29234 - protein, 123 aa, Artificial Sequence; identical to SEQ ID NO: 3841
  Description of Artificial Sequence: Synthetic polypeptide
  Immutep/INSERM/Novartis 34F4 VH

SEQ ID NO: 29235 - protein, 107 aa, Artificial Sequence; identical to SEQ ID NO: 3845
  Description of Artificial Sequence: Synthetic polypeptide
  Immutep/INSERM/Novartis 34F4 VH

SEQ ID NO: 29236 - protein, 123 aa, Artificial Sequence; identical to SEQ ID NO: 3849
  Description of Artificial Sequence: Synthetic polypeptide
  Immutep/INSERM/Novartis IMP761 VH

SEQ ID NO: 29237 - protein, 107 aa, Artificial Sequence; identical to SEQ ID NO: 3853
  Description of Artificial Sequence: Synthetic polypeptide
  Immutep/INSERM/Novartis IMP761 VH

SEQ ID NO: 29238 - protein, 116 aa, Artificial Sequence; identical to SEQ ID NO: 3857
  Description of Artificial Sequence: Synthetic polypeptide
  GSK H5L7 VH

SEQ ID NO: 29239 - protein, 114 aa, Artificial Sequence
  Description of Artificial Sequence: Synthetic polypeptide
  GSK H5L7 VL
DIQMTQSPSSLSASVGDRVTITCKSSQSLLNPSNQKNYLAWYQQKPGKAPKLLVYFASTRDSGVPSRFSGSGSGTDFTLTISSLQPEDFATYYCLQHFGTPPTFGQGTKLEIKR

SEQ ID NO: 29240 - protein, 119 aa, Artificial Sequence; identical to SEQ ID NO: 3865
  Description of Artificial Sequence: Synthetic polypeptide
  Merck hu22D2 VH

SEQ ID NO: 29241 - protein, 111 aa, Artificial Sequence; identical to SEQ ID NO: 3869
  Description of Artificial Sequence: Synthetic polypeptide
  Merck hu22D2 VL

SEQ ID NO: 29242 - protein, 123 aa, Artificial Sequence; identical to SEQ ID NO: 3873
  Description of Artificial Sequence: Synthetic polypeptide
  Regeneron H4sH15482P VH

SEQ ID NO: 29243 - protein, 107 aa, Artificial Sequence; identical to SEQ ID NO: 3877
  Description of Artificial Sequence: Synthetic polypeptide
  Regeneron H4sH15482P VH

SEQ ID NO: 29244 - protein, 119 aa, Artificial Sequence; identical to SEQ ID NO: 3881
  Description of Artificial Sequence: Synthetic polypeptide
  Sorrento L35D4 VH

SEQ ID NO: 29245 - protein, 112 aa, Artificial Sequence; identical to SEQ ID NO: 3885
  Description of Artificial Sequence: Synthetic polypeptide
  Sorrento L35D4 VL

SEQ ID NO: 29246 - protein, 119 aa, Artificial Sequence; identical to SEQ ID NO: 3881
  Description of Artificial Sequence: Synthetic polypeptide
  Sorrento L35G6 VH

SEQ ID NO: 29247 - protein, 110 aa, Artificial Sequence; identical to SEQ ID NO: 3893
  Description of Artificial Sequence: Synthetic polypeptide
  Sorrento L35G6 VL

SEQ ID NO: 29248 - protein, 119 aa, Artificial Sequence; identical to SEQ ID NO: 3881
  Description of Artificial Sequence: Synthetic polypeptide
  Sorrento L33H11 VH

SEQ ID NO: 29249 - protein, 110 aa, Artificial Sequence; identical to SEQ ID NO: 3901
  Description of Artificial Sequence: Synthetic polypeptide
  Sorrento L33H11 VL

SEQ ID NO: 29250 - protein, 119 aa, Artificial Sequence; identical to SEQ ID NO: 3881
  Description of Artificial Sequence: Synthetic polypeptide
  Sorrento L32A9 VH

SEQ ID NO: 29251 - protein, 110 aa, Artificial Sequence; identical to SEQ ID NO: 3909
  Description of Artificial Sequence: Synthetic polypeptide
  Sorrento L32A9 VL

SEQ ID NO: 29252 - protein, 119 aa, Artificial Sequence; identical to SEQ ID NO: 3881
  Description of Artificial Sequence: Synthetic polypeptide
  Sorrento L32D10 VH

SEQ ID NO: 29253 - protein, 110 aa, Artificial Sequence; identical to SEQ ID NO: 3917
  Description of Artificial Sequence: Synthetic polypeptide
  Sorrento L32D10 VL

SEQ ID NO: 29254 - protein, 119 aa, Artificial Sequence; identical to SEQ ID NO: 3881
  Description of Artificial Sequence: Synthetic polypeptide
  Sorrento L32A4 VH

SEQ ID NO: 29255 - protein, 110 aa, Artificial Sequence; identical to SEQ ID NO: 3925
  Description of Artificial Sequence: Synthetic polypeptide
  Sorrento L32A4 VL

SEQ ID NO: 29256 - protein, 119 aa, Artificial Sequence; identical to SEQ ID NO: 3929
  Description of Artificial Sequence: Synthetic polypeptide
  Sorrento L3A1 VH

SEQ ID NO: 29257 - protein, 110 aa, Artificial Sequence; identical to SEQ ID NO: 3933
  Description of Artificial Sequence: Synthetic polypeptide
  Sorrento L3A1 VL

SEQ ID NO: 29258 - protein, 121 aa, Artificial Sequence; identical to SEQ ID NO: 3937
  Description of Artificial Sequence: Synthetic polypeptide
  Sorrento L3A10 VH

SEQ ID NO: 29259 - protein, 108 aa, Artificial Sequence; identical to SEQ ID NO: 3941
  Description of Artificial Sequence: Synthetic polypeptide
  Sorrento L3A10 VL

SEQ ID NO: 29260 - protein, 121 aa, Artificial Sequence; identical to SEQ ID NO: 3945
  Description of Artificial Sequence: Synthetic polypeptide
  Sorrento L3C5 VH

SEQ ID NO: 29261 - protein, 110 aa, Artificial Sequence; identical to SEQ ID NO: 3949
  Description of Artificial Sequence: Synthetic polypeptide
  Sorrento L3C5 VL

SEQ ID NO: 29262 - protein, 119 aa, Artificial Sequence; identical to SEQ ID NO: 3929
  Description of Artificial Sequence: Synthetic polypeptide
  Sorrento L3E3 VH

SEQ ID NO: 29263 - protein, 110 aa, Artificial Sequence; identical to SEQ ID NO: 3957
  Description of Artificial Sequence: Synthetic polypeptide
  Sorrento L3E3 VL

SEQ ID NO: 29264 - protein, 114 aa, Artificial Sequence
  Description of Artificial Sequence: Synthetic polypeptide
  AnaptysBio/Tesaro APE5137 VH
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSSA

SEQ ID NO: 29265 - protein, 108 aa, Artificial Sequence
  Description of Artificial Sequence: Synthetic polypeptide
  AnaptysBio/Tesaro APE5137 VL
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIKR

SEQ ID NO: 29266 - protein, 120 aa, Artificial Sequence
  Description of Artificial Sequence: Synthetic polypeptide
  AnaptysBio/Tesaro APE5121 VH
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSSG

SEQ ID NO: 29267 - protein, 113 aa, Artificial Sequence; identical to SEQ ID NO: 4597
  Description of Artificial Sequence: Synthetic polypeptide
  AnaptysBio/Tesaro APE5121 VL

SEQ ID NO: 29268 - protein, 118 aa, Artificial Sequence; identical to SEQ ID NO: 4601
  Description of Artificial Sequence: Synthetic polypeptide
  Dana-Farber/Novartis ABTIM3-hum03 VH

SEQ ID NO: 29269 - protein, 111 aa, Artificial Sequence; identical to SEQ ID NO: 4605
  Description of Artificial Sequence: Synthetic polypeptide
  Dana-Farber/Novartis ABTIM3-hum03 VL

SEQ ID NO: 29270 - protein, 118 aa, Artificial Sequence; identical to SEQ ID NO: 4609
  Description of Artificial Sequence: Synthetic polypeptide
  Dana-Farber/Novartis ABTIM3-hum11 VH

SEQ ID NO: 29271 - protein, 111 aa, Artificial Sequence; identical to SEQ ID NO: 4613
  Description of Artificial Sequence: Synthetic polypeptide
  Dana-Farber/Novartis ABTIM3-hum11 VL

SEQ ID NO: 29272 - protein, 118 aa, Artificial Sequence; identical to SEQ ID NO: 4601
  Description of Artificial Sequence: Synthetic polypeptide
  Dana-Farber/Novartis ABTIM3-hum21 VH

SEQ ID NO: 29273 - protein, 111 aa, Artificial Sequence; identical to SEQ ID NO: 4605
  Description of Artificial Sequence: Synthetic polypeptide
  Dana-Farber/Novartis ABTIM3-hum21 VL

SEQ ID NO: 29274 - protein, 121 aa, Artificial Sequence; identical to SEQ ID NO: 4625
  Description of Artificial Sequence: Synthetic polypeptide
  KHK 4177 VH

SEQ ID NO: 29275 - protein, 109 aa, Artificial Sequence; identical to SEQ ID NO: 4629
  Description of Artificial Sequence: Synthetic polypeptide
  KHK 4177 VL

SEQ ID NO: 29276 - protein, 121 aa, Artificial Sequence; identical to SEQ ID NO: 4633
  Description of Artificial Sequence: Synthetic polypeptide
  KHK 4545 VH

SEQ ID NO: 29277 - protein, 107 aa, Artificial Sequence; identical to SEQ ID NO: 4637
  Description of Artificial Sequence: Synthetic polypeptide
  KHK 4545 VL

SEQ ID NO: 29278 - protein, 117 aa, Artificial Sequence; identical to SEQ ID NO: 4641
  Description of Artificial Sequence: Synthetic polypeptide
  KHK 8123 VH

SEQ ID NO: 29279 - protein, 107 aa, Artificial Sequence; identical to SEQ ID NO: 4645
  Description of Artificial Sequence: Synthetic polypeptide
  KHK 8123 VL

SEQ ID NO: 29280 - protein, 117 aa, Artificial Sequence; identical to SEQ ID NO: 4649
  Description of Artificial Sequence: Synthetic polypeptide
  Jounce mAb15 VH

SEQ ID NO: 29281 - protein, 113 aa, Artificial Sequence; identical to SEQ ID NO: 4653
  Description of Artificial Sequence: Synthetic polypeptide
  Jounce mAb15 VL

SEQ ID NO: 29282 - protein, 121 aa, Artificial Sequence; identical to SEQ ID NO: 4657
  Description of Artificial Sequence: Synthetic polypeptide
  Jounce mAb58 VH

SEQ ID NO: 29283 - protein, 107 aa, Artificial Sequence; identical to SEQ ID NO: 4661
  Description of Artificial Sequence: Synthetic polypeptide
  Jounce mAb58 VL

SEQ ID NO: 29284 - protein, 120 aa, Artificial Sequence; identical to SEQ ID NO: 4665
  Description of Artificial Sequence: Synthetic polypeptide
  Roche TIM3-0433 VH

SEQ ID NO: 29285 - protein, 106 aa, Artificial Sequence; identical to SEQ ID NO: 4669
  Description of Artificial Sequence: Synthetic polypeptide
  Roche TIM3-0433 VH

SEQ ID NO: 29286 - protein, 120 aa, Artificial Sequence; identical to SEQ ID NO: 4665
  Description of Artificial Sequence: Synthetic polypeptide
  Roche TIM3-0434 VH

SEQ ID NO: 29287 - protein, 106 aa, Artificial Sequence; identical to SEQ ID NO: 4677
  Description of Artificial Sequence: Synthetic polypeptide
  Roche TIM3-0434 VH

SEQ ID NO: 29288 - protein, 119 aa, Artificial Sequence; identical to SEQ ID NO: 4681
  Description of Artificial Sequence: Synthetic polypeptide
  Roche TIM3-0438 VH

SEQ ID NO: 29289 - protein, 107 aa, Artificial Sequence; identical to SEQ ID NO: 4685
  Description of Artificial Sequence: Synthetic polypeptide
  Roche TIM3-0438 VH

SEQ ID NO: 29290 - protein, 119 aa, Artificial Sequence; identical to SEQ ID NO: 4689
  Description of Artificial Sequence: Synthetic polypeptide
  Roche TIM3-0443 VH

SEQ ID NO: 29291 - protein, 107 aa, Artificial Sequence; identical to SEQ ID NO: 4685
  Description of Artificial Sequence: Synthetic polypeptide
  Roche TIM3-0443 VH

SEQ ID NO: 29292 - protein, 120 aa, Artificial Sequence; identical to SEQ ID NO: 3705
  Description of Artificial Sequence: Synthetic polypeptide
  Medarex 3C2 VH

SEQ ID NO: 29293 - protein, 107 aa, Artificial Sequence [sequence omitted]

SEQ ID NO: 29294 - protein, 127 aa, Artificial Sequence; identical to SEQ ID NO: 3713
  Description of Artificial Sequence: Synthetic polypeptide
  Medarex 11E2 VH

SEQ ID NO: 29295 - protein, 107 aa, Artificial Sequence; identical to SEQ ID NO: 3717
  Description of Artificial Sequence: Synthetic polypeptide
  Medarex 11E2 VL

SEQ ID NO: 29296 - protein, 119 aa, Artificial Sequence; identical to SEQ ID NO: 3721
  Description of Artificial Sequence: Synthetic polypeptide
  Medarex 4C7 VH

SEQ ID NO: 29297 - protein, 108 aa, Artificial Sequence; identical to SEQ ID NO: 3725
  Description of Artificial Sequence: Synthetic polypeptide
  Medarex 4C7 VL

SEQ ID NO: 29298 - protein, 121 aa, Artificial Sequence; identical to SEQ ID NO: 3729
  Description of Artificial Sequence: Synthetic polypeptide
  Medarex 8D5 VH

SEQ ID NO: 29299 - protein, 108 aa, Artificial Sequence; identical to SEQ ID NO: 3733
  Description of Artificial Sequence: Synthetic polypeptide
  Medarex 8D5 VL

SEQ ID NO: 29300 - protein, 119 aa, Artificial Sequence; identical to SEQ ID NO: 4433
  Description of Artificial Sequence: Synthetic polypeptide
  Genentech 10A7 VH

SEQ ID NO: 29301 - protein, 113 aa, Artificial Sequence; identical to SEQ ID NO: 4437
  Description of Artificial Sequence: Synthetic polypeptide
  Genentech 10A7 VL

SEQ ID NO: 29302 - protein, 119 aa, Artificial Sequence; identical to SEQ ID NO: 4441
  Description of Artificial Sequence: Synthetic polypeptide
  Genentech 1F4 VH

SEQ ID NO: 29303 - protein, 112 aa, Artificial Sequence; identical to SEQ ID NO: 4445
  Description of Artificial Sequence: Synthetic polypeptide
  Genentech 1F4 VL

SEQ ID NO: 29304 - protein, 126 aa, Artificial Sequence; identical to SEQ ID NO: 4449
  Description of Artificial Sequence: Synthetic polypeptide
  Genentech 4.1D3 VH

SEQ ID NO: 29305 - protein, 113 aa, Artificial Sequence; identical to SEQ ID NO: 4453
  Description of Artificial Sequence: Synthetic polypeptide
  Genentech 4.1D3 VL

SEQ ID NO: 29306 - protein, 126 aa, Artificial Sequence; identical to SEQ ID NO: 4457
  Description of Artificial Sequence: Synthetic polypeptide
  Genentech 4.1D3.Q1E VH

SEQ ID NO: 29307 - protein, 113 aa, Artificial Sequence; identical to SEQ ID NO: 4453
  Description of Artificial Sequence: Synthetic polypeptide
  Genentech 4.1D3.Q1E VL

SEQ ID NO: 29308 - protein, 119 aa, Artificial Sequence; identical to SEQ ID NO: 4513
  Description of Artificial Sequence: Synthetic polypeptide
  Merck MEB125.31C6.A1.205 VH4/VL1 VH

SEQ ID NO: 29309 - protein, 107 aa, Artificial Sequence; identical to SEQ ID NO: 4517
  Description of Artificial Sequence: Synthetic polypeptide
  Merck MEB125.31C6.A1.205 VH4/VL1 VL

SEQ ID NO: 29310 - protein, 119 aa, Artificial Sequence; identical to SEQ ID NO: 4521
  Description of Artificial Sequence: Synthetic polypeptide
  Merck MEB125.31C6.A1.205 VH5/VL4 VH

SEQ ID NO: 29311 - protein, 107 aa, Artificial Sequence; identical to SEQ ID NO: 4525
  Description of Artificial Sequence: Synthetic polypeptide
  Merck MEB125.31C6.A1.205 VH5/VL4 VL

SEQ ID NO: 29312 - protein, 119 aa, Artificial Sequence; identical to SEQ ID NO: 4521
  Description of Artificial Sequence: Synthetic polypeptide
  Merck MEB125.31C6.A1.205 VH5/VL3 VH

SEQ ID NO: 29313 - protein, 107 aa, Artificial Sequence; identical to SEQ ID NO: 4533
  Description of Artificial Sequence: Synthetic polypeptide
  Merck MEB125.31C6.A1.205 VH5/VL3 VL

SEQ ID NO: 29314 - protein, 121 aa, Artificial Sequence; identical to SEQ ID NO: 4465
  Description of Artificial Sequence: Synthetic polypeptide
  Merck Hu14D7 VH1

SEQ ID NO: 29315 - protein, 121 aa, Artificial Sequence; identical to SEQ ID NO: 4469
  Description of Artificial Sequence: Synthetic polypeptide
  Merck Hu14D7 VH2

SEQ ID NO: 29316 - protein, 121 aa, Artificial Sequence; identical to SEQ ID NO: 4473
  Description of Artificial Sequence: Synthetic polypeptide
  Merck Hu14D7 VH3

SEQ ID NO: 29317 - protein, 108 aa, Artificial Sequence; identical to SEQ ID NO: 4477
  Description of Artificial Sequence: Synthetic polypeptide
  Merck Hu14D7 VL1

SEQ ID NO: 29318 - protein, 108 aa, Artificial Sequence; identical to SEQ ID NO: 4481
  Description of Artificial Sequence: Synthetic polypeptide
  Merck Hu14D7 VL2

SEQ ID NO: 29319 - protein, 108 aa, Artificial Sequence; identical to SEQ ID NO: 4485
  Description of Artificial Sequence: Synthetic polypeptide
  Merck Hu14D7 VL3

SEQ ID NO: 29320 - protein, 119 aa, Artificial Sequence; identical to SEQ ID NO: 4489
  Description of Artificial Sequence: Synthetic polypeptide
  Merck Hu26B10 VH1

SEQ ID NO: 29321 - protein, 119 aa, Artificial Sequence; identical to SEQ ID NO: 4493
  Description of Artificial Sequence: Synthetic polypeptide
  Merck Hu26B10 VH2

SEQ ID NO: 29322 - protein, 119 aa, Artificial Sequence; identical to SEQ ID NO: 4497
  Description of Artificial Sequence: Synthetic polypeptide
  Merck Hu26B10 VH3

SEQ ID NO: 29323 - protein, 107 aa, Artificial Sequence; identical to SEQ ID NO: 4501
  Description of Artificial Sequence: Synthetic polypeptide
  Merck Hu26B10 VL1

SEQ ID NO: 29324 - protein, 107 aa, Artificial Sequence; identical to SEQ ID NO: 4505
  Description of Artificial Sequence: Synthetic polypeptide
  Merck Hu26B10 VL2

SEQ ID NO: 29325 - protein, 107 aa, Artificial Sequence; identical to SEQ ID NO: 4509
  Description of Artificial Sequence: Synthetic polypeptide
  Merck Hu26B10 VL3

SEQ ID NO: 29326 - protein, 118 aa, Artificial Sequence; identical to SEQ ID NO: 4537
  Description of Artificial Sequence: Synthetic polypeptide
  BMS 15A6 VH

SEQ ID NO: 29327 - protein, 107 aa, Artificial Sequence; identical to SEQ ID NO: 4541
  Description of Artificial Sequence: Synthetic polypeptide
  BMS 15A6 VL

SEQ ID NO: 29328 - protein, 130 aa, Artificial Sequence; identical to SEQ ID NO: 4545
  Description of Artificial Sequence: Synthetic polypeptide
  BMS 22G2 VH

SEQ ID NO: 29329 - protein, 109 aa, Artificial Sequence; identical to SEQ ID NO: 4549
  Description of Artificial Sequence: Synthetic polypeptide
  BMS 22G2 VL

SEQ ID NO: 29330 - protein, 126 aa, Artificial Sequence; identical to SEQ ID NO: 4553
  Description of Artificial Sequence: Synthetic polypeptide
  BMS 11G11 VH

SEQ ID NO: 29331 - protein, 106 aa, Artificial Sequence; identical to SEQ ID NO: 4557
  Description of Artificial Sequence: Synthetic polypeptide
  BMS 11G11 VL

SEQ ID NO: 29332 - protein, 128 aa, Artificial Sequence; identical to SEQ ID NO: 4561
  Description of Artificial Sequence: Synthetic polypeptide
  BMS 10D7 VH

SEQ ID NO: 29333 - protein, 107 aa, Artificial Sequence; identical to SEQ ID NO: 4565
  Description of Artificial Sequence: Synthetic polypeptide
  BMS 10D7 VL

SEQ ID NO: 29334 - protein, 116 aa, Artificial Sequence; identical to SEQ ID NO: 4569
  Description of Artificial Sequence: Synthetic polypeptide
  Oncomed 313R19 VH

SEQ ID NO: 29335 - protein, 111 aa, Artificial Sequence
  Description of Artificial Sequence: Synthetic polypeptide
  Oncomed 313R19 VL
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIKR

SEQ ID NO: 29336 - protein, 118 aa, Artificial Sequence; identical to SEQ ID NO: 4577
  Description of Artificial Sequence: Synthetic polypeptide
  Oncomed 313M32 VH

SEQ ID NO: 29337 - protein, 99 aa, Artificial Sequence; identical to SEQ ID NO: 4581
  Description of Artificial Sequence: Synthetic polypeptide
  Oncomed 313M32 VL

SEQ ID NO: 29338 - protein, 118 aa, Artificial Sequence; identical to SEQ ID NO: 25612
  Description of Artificial Sequence: Synthetic polypeptide
  VH of XENP20269

SEQ ID NO: 29339 - protein, 5 aa, Artificial Sequence
  Description of Artificial Sequence: Synthetic peptide
  XENP20269 vhCDR1
GYGVN

SEQ ID NO: 29340 - protein, 16 aa, Artificial Sequence
  Description of Artificial Sequence: Synthetic peptide
  XENP20269 vhCDR2
MIWIDGSTDYNSALKS

SEQ ID NO: 29341 - protein, 10 aa, Artificial Sequence
  Description of Artificial Sequence: Synthetic peptide
  XENP20269 vhCDR3
DRPDGRAMDY

SEQ ID NO: 29342 - protein, 106 aa, Artificial Sequence; identical to SEQ ID NO: 25617
  Description of Artificial Sequence: Synthetic polypeptide
  VL of XENP20269

SEQ ID NO: 29343 - protein, 11 aa, Artificial Sequence
  Description of Artificial Sequence: Synthetic peptide
  XENP20269 vlCDR1
KASQSVSNDVA

SEQ ID NO: 29344 - protein, 7 aa, Artificial Sequence
  Description of Artificial Sequence: Synthetic peptide
  XENP20269 vlCDR2
YASNRYT

SEQ ID NO: 29345 - protein, 8 aa, Artificial Sequence
  Description of Artificial Sequence: Synthetic peptide
  XENP20269 vlCDR3
QQDYSSPT

SEQ ID NO: 29346 - protein, 118 aa, Artificial Sequence; identical to SEQ ID NO: 3146
  Description of Artificial Sequence: Synthetic polypeptide
  VH of XENP20872

SEQ ID NO: 29347 - protein, 5 aa, Artificial Sequence
  Description of Artificial Sequence: Synthetic peptide
  XENP20872 vhCDR1
GYGVN

SEQ ID NO: 29348 - protein, 16 aa, Artificial Sequence
  Description of Artificial Sequence: Synthetic peptide
  XENP20872 vhCDR2
MIWIDGSTDYNSKFQG

SEQ ID NO: 29349 - protein, 10 aa, Artificial Sequence
  Description of Artificial Sequence: Synthetic peptide
  XENP20872 vhCDR3
DRPDGRAMDY

SEQ ID NO: 29350 - protein, 106 aa, Artificial Sequence; identical to SEQ ID NO: 3161
  Description of Artificial Sequence: Synthetic polypeptide
  VL of XENP20872

SEQ ID NO: 29351 - protein, 11 aa, Artificial Sequence
  Description of Artificial Sequence: Synthetic peptide
  XENP20872 vlCDR1
KASQSVSNDVA

SEQ ID NO: 29352 - protein, 7 aa, Artificial Sequence
  Description of Artificial Sequence: Synthetic peptide
  XENP20872 vlCDR2
YASNRYT

SEQ ID NO: 29353 - protein, 8 aa, Artificial Sequence
  Description of Artificial Sequence: Synthetic peptide
  XENP20872 vlCDR3
QQDYSSPT

SEQ ID NO: 29354 - protein, 118 aa, Artificial Sequence; identical to SEQ ID NO: 25981
  Description of Artificial Sequence: Synthetic polypeptide
  VH of XENP020882

SEQ ID NO: 29355 - protein, 5 aa, Artificial Sequence
  Description of Artificial Sequence: Synthetic peptide
  XENP020882 vhCDR1
GYGVN

SEQ ID NO: 29356 - protein, 16 aa, Artificial Sequence
  Description of Artificial Sequence: Synthetic peptide
  XENP020882 vhCDR2
MIWIDGSTDYNSKFQG

SEQ ID NO: 29357 - protein, 10 aa, Artificial Sequence
  Description of Artificial Sequence: Synthetic peptide
  XENP020882 vhCDR3
DRPDGRAMDY

SEQ ID NO: 29358 - protein, 106 aa, Artificial Sequence; identical to SEQ ID NO: 3161
  Description of Artificial Sequence: Synthetic polypeptide
  VL of XENP020882

SEQ ID NO: 29359 - protein, 11 aa, Artificial Sequence
  Description of Artificial Sequence: Synthetic peptide
  XENP020882 vlCDR1
KASQSVSNDVA

SEQ ID NO: 29360 - protein, 7 aa, Artificial Sequence
  Description of Artificial Sequence: Synthetic peptide
  XENP020882 vlCDR2
YASNRYT

SEQ ID NO: 29361 - protein, 8 aa, Artificial Sequence
  Description of Artificial Sequence: Synthetic peptide
  XENP020882 vlCDR3
QQDYSSPT

SEQ ID NO: 29362 - protein, 122 aa, Artificial Sequence; identical to SEQ ID NO: 2872
  Description of Artificial Sequence: Synthetic polypeptide
  VH of XENP19690

SEQ ID NO: 29363 - protein, 5 aa, Artificial Sequence
  Description of Artificial Sequence: Synthetic peptide
  XENP19690 vhCDR1
NYWMN

SEQ ID NO: 29364 - protein, 19 aa, Artificial Sequence
  Description of Artificial Sequence: Synthetic peptide
  XENP19690 vhCDR2
EIRLYSNNYATHYAESVKG

SEQ ID NO: 29365 - protein, 11 aa, Artificial Sequence
  Description of Artificial Sequence: Synthetic peptide
  XENP19690 vhCDR3
YYGNYGGYFDV

SEQ ID NO: 29366 - protein, 20 aa, Artificial Sequence
  Description of Artificial Sequence: Synthetic peptide
  XENP19690 scFv
GKPGSGKPGSGKPGSGKPGS

SEQ ID NO: 29367 - protein, 107 aa, Artificial Sequence; identical to SEQ ID NO: 2871
  Description of Artificial Sequence: Synthetic polypeptide
  VL of XENP19690

SEQ ID NO: 29368 - protein, 11 aa, Artificial Sequence
  Description of Artificial Sequence: Synthetic peptide
  XENP19690 vlCDR1
RASQSVGNDVA

SEQ ID NO: 29369 - protein, 7 aa, Artificial Sequence
  Description of Artificial Sequence: Synthetic peptide
  XENP19690 vlCDR2
YASHRYT

SEQ ID NO: 29370 - protein, 9 aa, Artificial Sequence
  Description of Artificial Sequence: Synthetic peptide
  XENP19690 vlCDR3
QQDFSSPRT

SEQ ID NO: 29371 - protein, 249 aa, Artificial Sequence; identical to SEQ ID NO: 16051
  Description of Artificial Sequence: Synthetic polypeptide
  XENP19690 scFv

SEQ ID NO: 29372 - protein, 122 aa, Artificial Sequence; identical to SEQ ID NO: 15593
  Description of Artificial Sequence: Synthetic polypeptide

SEQ ID NO: 29373 - protein, 5 aa, Artificial Sequence
  Description of Artificial Sequence: Synthetic peptide
NYWMN

SEQ ID NO: 29374 - protein, 19 aa, Artificial Sequence
  Description of Artificial Sequence: Synthetic peptide
EIRLYSNNYATHYAESVKG

SEQ ID NO: 29375 - protein, 11 aa, Artificial Sequence
  Description of Artificial Sequence: Synthetic peptide
YYGNYGGYFDV

SEQ ID NO: 29376 - protein, 20 aa, Artificial Sequence
  Description of Artificial Sequence: Synthetic peptide
GKPGSGKPGSGKPGSGKPGS

SEQ ID NO: 29377 - protein, 107 aa, Artificial Sequence
  Description of Artificial Sequence: Synthetic polypeptide
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 29378 - protein, 11 aa, Artificial Sequence
  Description of Artificial Sequence: Synthetic peptide
RASQSVGNDVA

SEQ ID NO: 29379 - protein, 7 aa, Artificial Sequence
  Description of Artificial Sequence: Synthetic peptide
YASHRYT

SEQ ID NO: 29380 - protein, 9 aa, Artificial Sequence
  Description of Artificial Sequence: Synthetic peptide
QQDWSSPRT

SEQ ID NO: 29381 - protein, 249 aa, Artificial Sequence
  Description of Artificial Sequence: Synthetic polypeptide
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 29382 - protein, 107 aa, Artificial Sequence; identical to SEQ ID NO: 2871
  Description of Artificial Sequence: Synthetic polypeptide
  VH of XENP19692

SEQ ID NO: 29383 - protein, 11 aa, Artificial Sequence
  Description of Artificial Sequence: Synthetic peptide
  XENP19692 vhCDR1
RASQSVGNDVA

SEQ ID NO: 29384 - protein, 7 aa, Artificial Sequence
  Description of Artificial Sequence: Synthetic peptide
  XENP19692 vhCDR2
YASHRYT

SEQ ID NO: 29385 - protein, 9 aa, Artificial Sequence
  Description of Artificial Sequence: Synthetic peptide
  XENP19692 vhCDR3
QQDFSSPRT

SEQ ID NO: 29386 - protein, 20 aa, Artificial Sequence
  Description of Artificial Sequence: Synthetic peptide
  XENP19692 scFv
GKPGSGKPGSGKPGSGKPGS

SEQ ID NO: 29387 - protein, 122 aa, Artificial Sequence; identical to SEQ ID NO: 2872
  Description of Artificial Sequence: Synthetic polypeptide
  VL of XENP19692

SEQ ID NO: 29388 - protein, 5 aa, Artificial Sequence
  Description of Artificial Sequence: Synthetic peptide
  XENP19692 vlCDR1
NYWMN

SEQ ID NO: 29389 - protein, 19 aa, Artificial Sequence
  Description of Artificial Sequence: Synthetic peptide
  XENP19692 vlCDR2
EIRLYSNNYATHYAESVKG

SEQ ID NO: 29390 - protein, 11 aa, Artificial Sequence
  Description of Artificial Sequence: Synthetic peptide
  XENP19692 vlCDR3
YYGNYGGYFDV

SEQ ID NO: 29391 - protein, 249 aa, Artificial Sequence; identical to SEQ ID NO: 16069
  Description of Artificial Sequence: Synthetic polypeptide
  XENP19692 scFv

SEQ ID NO: 29392 - protein, 107 aa, Artificial Sequence; identical to SEQ ID NO: 16035
  Description of Artificial Sequence: Synthetic polypeptide
  VH of XENP19669

SEQ ID NO: 29393 - protein, 11 aa, Artificial Sequence
  Description of Artificial Sequence: Synthetic peptide
  XENP19669 vhCDR1
RASQSVGNDVA

SEQ ID NO: 29394 - protein, 7 aa, Artificial Sequence
  Description of Artificial Sequence: Synthetic peptide
  XENP19669 vhCDR2
YASHRYT

SEQ ID NO: 29395 - protein, 9 aa, Artificial Sequence
  Description of Artificial Sequence: Synthetic peptide
  XENP19669 vhCDR3
QQDFSSPRT

SEQ ID NO: 29396 - protein, 20 aa, Artificial Sequence
  Description of Artificial Sequence: Synthetic peptide
  XENP19669 scFv
GKPGSGKPGSGKPGSGKPGS

SEQ ID NO: 29397 - protein, 122 aa, Artificial Sequence; identical to SEQ ID NO: 16034
  Description of Artificial Sequence: Synthetic polypeptide
  VL of XENP19669

SEQ ID NO: 29398 - protein, 5 aa, Artificial Sequence
  Description of Artificial Sequence: Synthetic peptide
  XENP19669 vlCDR1
NYWMN

SEQ ID NO: 29399 - protein, 19 aa, Artificial Sequence
  Description of Artificial Sequence: Synthetic peptide
  XENP19669 vlCDR2
EIRLYSNNYATHYAESVKG

SEQ ID NO: 29400 - protein, 11 aa, Artificial Sequence
  Description of Artificial Sequence: Synthetic peptide
  XENP19669 vlCDR3
YYGNYGGYFDV

SEQ ID NO: 29401 - protein, 249 aa, Artificial Sequence; identical to SEQ ID NO: 16042
  Description of Artificial Sequence: Synthetic polypeptide
  XENP19669 scFv

SEQ ID NO: 29402 - protein, 120 aa, Artificial Sequence; identical to SEQ ID NO: 3091
  Description of Artificial Sequence: Synthetic polypeptide
  VH of XENP20162

SEQ ID NO: 29403 - protein, 5 aa, Artificial Sequence
  Description of Artificial Sequence: Synthetic peptide
  XENP20162 vhCDR1
NYWLG

SEQ ID NO: 29404 - protein, 17 aa, Artificial Sequence
  Description of Artificial Sequence: Synthetic peptide
  XENP20162 vhCDR2
NFYPGSSNTYYNEKFQG

SEQ ID NO: 29405 - protein, 11 aa, Artificial Sequence
  Description of Artificial Sequence: Synthetic peptide
  XENP20162 vhCDR3
HYGTNYRYFDV

SEQ ID NO: 29406 - protein, 20 aa, Artificial Sequence
  Description of Artificial Sequence: Synthetic peptide
  XENP20162 scFv
GKPGSGKPGSGKPGSGKPGS

SEQ ID NO: 29407 - protein, 107 aa, Artificial Sequence; identical to SEQ ID NO: 3092
  Description of Artificial Sequence: Synthetic polypeptide
  VL of XENP20162

SEQ ID NO: 29408 - protein, 11 aa, Artificial Sequence
  Description of Artificial Sequence: Synthetic peptide
  XENP20162 vlCDR1
RASQSVSNDVA

SEQ ID NO: 29409 - protein, 7 aa, Artificial Sequence
  Description of Artificial Sequence: Synthetic peptide
  XENP20162 vlCDR2
YASNRYT

SEQ ID NO: 29410 - protein, 9 aa, Artificial Sequence
  Description of Artificial Sequence: Synthetic peptide
  XENP20162 vlCDR3
QQDYSSPYT

SEQ ID NO: 29411 - protein, 247 aa, Artificial Sequence; identical to SEQ ID NO: 16087
  Description of Artificial Sequence: Synthetic polypeptide
  XENP20162 scFv

SEQ ID NO: 29412 - protein, 118 aa, Artificial Sequence; identical to SEQ ID NO: 5085
  Description of Artificial Sequence: Synthetic polypeptide
  VH of XENP19235 Fab, XENP19769 scFv

SEQ ID NO: 29413 - protein, 5 aa, Artificial Sequence
  Description of Artificial Sequence: Synthetic peptide
  XENP19235 Fab, XENP19769 scFv vhCDR1
SYAMH

SEQ ID NO: 29414 - protein, 17 aa, Artificial Sequence
  Description of Artificial Sequence: Synthetic peptide
  XENP19235 Fab, XENP19769 scFv vhCDR2
FISYDGNNKYYADSVKG

SEQ ID NO: 29415 - protein, 9 aa, Artificial Sequence
  Description of Artificial Sequence: Synthetic peptide
  XENP19235 Fab, XENP19769 scFv vhCDR3
TGWLGPFDY

SEQ ID NO: 29416 - protein, 20 aa, Artificial Sequence
  Description of Artificial Sequence: Synthetic peptide
  XENP19235 Fab, XENP19769 scFv scFv linker
GKPGSGKPGSGKPGSGKPGS

SEQ ID NO: 29417 - protein, 108 aa, Artificial Sequence; identical to SEQ ID NO: 3741
  Description of Artificial Sequence: Synthetic polypeptide
  VL of XENP19235 Fab, XENP19769 scFv

SEQ ID NO: 29418 - protein, 12 aa, Artificial Sequence
  Description of Artificial Sequence: Synthetic peptide
  XENP19235 Fab, XENP19769 scFv vlCDR1
RASQSVGSSYLA

SEQ ID NO: 29419 - protein, 7 aa, Artificial Sequence
  Description of Artificial Sequence: Synthetic peptide
  XENP19235 Fab, XENP19769 scFv vlCDR2
GAFSRAT

SEQ ID NO: 29420 - protein, 9 aa, Artificial Sequence
  Description of Artificial Sequence: Synthetic peptide
  XENP19235 Fab, XENP19769 scFv vlCDR3
QQYGSSPWT

SEQ ID NO: 29421 - protein, 246 aa, Artificial Sequence; identical to SEQ ID NO: 5084
  Description of Artificial Sequence: Synthetic polypeptide
  XENP19235 Fab, XENP19769 scFv scFv

SEQ ID NO: 29422 - protein, 118 aa, Artificial Sequence; identical to SEQ ID NO: 5094
  Description of Artificial Sequence: Synthetic polypeptide
  VH of XENP19236 Fab, XENP19770 scFv

SEQ ID NO: 29423 - protein, 5 aa, Artificial Sequence
  Description of Artificial Sequence: Synthetic peptide
  XENP19236 Fab, XENP19770 scFv vhCDR1
SYGMH

SEQ ID NO: 29424 - protein, 17 aa, Artificial Sequence
  Description of Artificial Sequence: Synthetic peptide
  XENP19236 Fab, XENP19770 scFv vhCDR2
FISYDGNNKYYADSVKG

SEQ ID NO: 29425 - protein, 9 aa, Artificial Sequence
  Description of Artificial Sequence: Synthetic peptide
  XENP19236 Fab, XENP19770 scFv vhCDR3
TGWLGPFDY

SEQ ID NO: 29426 - protein, 20 aa, Artificial Sequence
  Description of Artificial Sequence: Synthetic peptide
  XENP19236 Fab, XENP19770 scFv scFv linker
GKPGSGKPGSGKPGSGKPGS

SEQ ID NO: 29427 - protein, 108 aa, Artificial Sequence; identical to SEQ ID NO: 3741
  Description of Artificial Sequence: Synthetic polypeptide
  VL of XENP19236 Fab, XENP19770 scFv

SEQ ID NO: 29428 - protein, 12 aa, Artificial Sequence
  Description of Artificial Sequence: Synthetic peptide
  XENP19236 Fab, XENP19770 scFv vlCDR1
RASQSVGSSYLA

SEQ ID NO: 29429 - protein, 7 aa, Artificial Sequence
  Description of Artificial Sequence: Synthetic peptide
  XENP19236 Fab, XENP19770 scFv vlCDR2
GAFSRAT

SEQ ID NO: 29430 - protein, 9 aa, Artificial Sequence
  Description of Artificial Sequence: Synthetic peptide
  XENP19236 Fab, XENP19770 scFv vlCDR3
QQYGSSPWT

SEQ ID NO: 29431 - protein, 246 aa, Artificial Sequence; identical to SEQ ID NO: 5093
  Description of Artificial Sequence: Synthetic polypeptide
  XENP19236 Fab, XENP19770 scFv scFv

SEQ ID NO: 29432 - protein, 118 aa, Artificial Sequence; identical to SEQ ID NO: 5103
  Description of Artificial Sequence: Synthetic polypeptide
  VH of XENP19237 Fab, XENP19771 scFv

SEQ ID NO: 29433 - protein, 5 aa, Artificial Sequence
  Description of Artificial Sequence: Synthetic peptide
  XENP19237 Fab, XENP19771 scFv vhCDR1
SYSMH

SEQ ID NO: 29434 - protein, 17 aa, Artificial Sequence
  Description of Artificial Sequence: Synthetic peptide
  XENP19237 Fab, XENP19771 scFv vhCDR2
FISYDGNNKYYADSVKG

SEQ ID NO: 29435 - protein, 9 aa, Artificial Sequence
  Description of Artificial Sequence: Synthetic peptide
  XENP19237 Fab, XENP19771 scFv vhCDR3
TGWLGPFDY

SEQ ID NO: 29436 - protein, 20 aa, Artificial Sequence
  Description of Artificial Sequence: Synthetic peptide
  XENP19237 Fab, XENP19771 scFv scFv linker
GKPGSGKPGSGKPGSGKPGS

SEQ ID NO: 29437 - protein, 108 aa, Artificial Sequence; identical to SEQ ID NO: 3741
  Description of Artificial Sequence: Synthetic polypeptide
  VL of XENP19237 Fab, XENP19771 scFv

SEQ ID NO: 29438 - protein, 12 aa, Artificial Sequence
  Description of Artificial Sequence: Synthetic peptide
  XENP19237 Fab, XENP19771 scFv vlCDR1
RASQSVGSSYLA

SEQ ID NO: 29439 - protein, 7 aa, Artificial Sequence
  Description of Artificial Sequence: Synthetic peptide
  XENP19237 Fab, XENP19771 scFv vlCDR2
GAFSRAT

SEQ ID NO: 29440 - protein, 9 aa, Artificial Sequence
  Description of Artificial Sequence: Synthetic peptide
  XENP19237 Fab, XENP19771 scFv vlCDR3
QQYGSSPWT

SEQ ID NO: 29441 - protein, 246 aa, Artificial Sequence; identical to SEQ ID NO: 5102
  Description of Artificial Sequence: Synthetic polypeptide
  XENP19237 Fab, XENP19771 scFv scFv

SEQ ID NO: 29442 - protein, 20 aa, Artificial Sequence
  Description of Artificial Sequence: Synthetic peptide
  Fab XENP19773, scFv XENP19239 scFv linker
GKPGSGKPGSGKPGSGKPGS

SEQ ID NO: 29443 - protein, 246 aa, Artificial Sequence; identical to SEQ ID NO: 5120
  Description of Artificial Sequence: Synthetic polypeptide
  Fab XENP19773, scFv XENP19239 scFv

SEQ ID NO: 29444 - protein, 118 aa, Artificial Sequence; identical to SEQ ID NO: 5202
  Description of Artificial Sequence: Synthetic polypeptide
  VH of Fab XENP19248, scFv XENP19782

SEQ ID NO: 29445 - protein, 5 aa, Artificial Sequence
  Description of Artificial Sequence: Synthetic peptide
  Fab XENP19248, scFv XENP19782 vhCDR1
SYTMH

SEQ ID NO: 29446 - protein, 17 aa, Artificial Sequence
  Description of Artificial Sequence: Synthetic peptide
  Fab XENP19248, scFv XENP19782 vhCDR2
FISYDGNNKYYADSVKG

SEQ ID NO: 29447 - protein, 9 aa, Artificial Sequence
  Description of Artificial Sequence: Synthetic peptide
  Fab XENP19248, scFv XENP19782 vhCDR3
TGWLGPFDY

SEQ ID NO: 29448 - protein, 20 aa, Artificial Sequence
  Description of Artificial Sequence: Synthetic peptide
  Fab XENP19248, scFv XENP19782 scFv linker
GKPGSGKPGSGKPGSGKPGS

SEQ ID NO: 29449 - protein, 108 aa, Artificial Sequence; identical to SEQ ID NO: 3741
  Description of Artificial Sequence: Synthetic polypeptide
  VL of Fab XENP19248, scFv XENP19782

SEQ ID NO: 29450 - protein, 12 aa, Artificial Sequence
  Description of Artificial Sequence: Synthetic peptide
  Fab XENP19248, scFv XENP19782 vlCDR1
RASQSVGSSYLA

SEQ ID NO: 29451 - protein, 7 aa, Artificial Sequence
  Description of Artificial Sequence: Synthetic peptide
  Fab XENP19248, scFv XENP19782 vlCDR2
GAFSRAT

SEQ ID NO: 29452 - protein, 9 aa, Artificial Sequence
  Description of Artificial Sequence: Synthetic peptide
  Fab XENP19248, scFv XENP19782 vlCDR3
QQYGSSPWT

SEQ ID NO: 29453 - protein, 246 aa, Artificial Sequence; identical to SEQ ID NO: 5201
  Description of Artificial Sequence: Synthetic polypeptide
  Fab XENP19248, scFv XENP19782 scFv

SEQ ID NO: 29454 - protein, 118 aa, Artificial Sequence; identical to SEQ ID NO: 5211
  Description of Artificial Sequence: Synthetic polypeptide
  VH of Fab XENP19249, scFv XENP19783

SEQ ID NO: 29455 - protein, 5 aa, Artificial Sequence
  Description of Artificial Sequence: Synthetic peptide
  Fab XENP19249, scFv XENP19783 vhCDR1
SYTMH

SEQ ID NO: 29456 - protein, 17 aa, Artificial Sequence
  Description of Artificial Sequence: Synthetic peptide
  Fab XENP19249, scFv XENP19783 vhCDR2
FISYDGNNKYYADSVKG

SEQ ID NO: 29457 - protein, 9 aa, Artificial Sequence
  Description of Artificial Sequence: Synthetic peptide
  Fab XENP19249, scFv XENP19783 vhCDR3
TGWLGPFDY

SEQ ID NO: 29458 - protein, 20 aa, Artificial Sequence
  Description of Artificial Sequence: Synthetic peptide
  Fab XENP19249, scFv XENP19783 scFv linker
GKPGSGKPGSGKPGSGKPGS

SEQ ID NO: 29459 - protein, 108 aa, Artificial Sequence; identical to SEQ ID NO: 3741
  Description of Artificial Sequence: Synthetic polypeptide
  VL of Fab XENP19249, scFv XENP19783

SEQ ID NO: 29460 - protein, 12 aa, Artificial Sequence
  Description of Artificial Sequence: Synthetic peptide
  Fab XENP19249, scFv XENP19783 vlCDR1
RASQSVGSSYLA

SEQ ID NO: 29461 - protein, 7 aa, Artificial Sequence
  Description of Artificial Sequence: Synthetic peptide
  Fab XENP19249, scFv XENP19783 vlCDR2
GAFSRAT

SEQ ID NO: 29462 - protein, 9 aa, Artificial Sequence
  Description of Artificial Sequence: Synthetic peptide
  Fab XENP19249, scFv XENP19783 vlCDR3
QQYGSSPWT

SEQ ID NO: 29463 - protein, 246 aa, Artificial Sequence; identical to SEQ ID NO: 5210
  Description of Artificial Sequence: Synthetic polypeptide
  Fab XENP19249, scFv XENP19783 scFv

SEQ ID NO: 29464 - protein, 118 aa, Artificial Sequence; identical to SEQ ID NO: 5220
  Description of Artificial Sequence: Synthetic polypeptide
  VH of Fab XENP19250, scFv XENP19784

SEQ ID NO: 29465 - protein, 5 aa, Artificial Sequence
  Description of Artificial Sequence: Synthetic peptide
  Fab XENP19250, scFv XENP19784 vhCDR1
SYTMH

SEQ ID NO: 29466 - protein, 17 aa, Artificial Sequence
  Description of Artificial Sequence: Synthetic peptide
  Fab XENP19250, scFv XENP19784 vhCDR2
FISYDGNNKYYADSVKG

SEQ ID NO: 29467 - protein, 9 aa, Artificial Sequence
  Description of Artificial Sequence: Synthetic peptide
  Fab XENP19250, scFv XENP19784 vhCDR3
TGWLGPFDY

SEQ ID NO: 29468 - protein, 20 aa, Artificial Sequence
  Description of Artificial Sequence: Synthetic peptide
  Fab XENP19250, scFv XENP19784 scFv linker
GKPGSGKPGSGKPGSGKPGS

SEQ ID NO: 29469 - protein, 108 aa, Artificial Sequence; identical to SEQ ID NO: 3741
  Description of Artificial Sequence: Synthetic polypeptide
  VL of Fab XENP19250, scFv XENP19784

SEQ ID NO: 29470 - protein, 12 aa, Artificial Sequence
  Description of Artificial Sequence: Synthetic peptide
  Fab XENP19250, scFv XENP19784 vlCDR1
RASQSVGSSYLA

SEQ ID NO: 29471 - protein, 7 aa, Artificial Sequence
  Description of Artificial Sequence: Synthetic peptide
  Fab XENP19250, scFv XENP19784 vlCDR2
GAFSRAT

SEQ ID NO: 29472 - protein, 9 aa, Artificial Sequence
  Description of Artificial Sequence: Synthetic peptide
  Fab XENP19250, scFv XENP19784 vlCDR3
QQYGSSPWT

SEQ ID NO: 29473 - protein, 246 aa, Artificial Sequence; identical to SEQ ID NO: 5219
  Description of Artificial Sequence: Synthetic polypeptide
  Fab XENP19250, scFv XENP19784 scFv

SEQ ID NO: 29474 - protein, 118 aa, Artificial Sequence; identical to SEQ ID NO: 5490
  Description of Artificial Sequence: Synthetic polypeptide
  VH of Fab XENP19280, scFv XENP19818

SEQ ID NO: 29475 - protein, 5 aa, Artificial Sequence
  Description of Artificial Sequence: Synthetic peptide
  Fab XENP19280, scFv XENP19818 vhCDR1
SYTMH

SEQ ID NO: 29476 - protein, 17 aa, Artificial Sequence
  Description of Artificial Sequence: Synthetic peptide
  Fab XENP19280, scFv XENP19818 vhCDR2
FISYDGSNKYYADSVKG

SEQ ID NO: 29477 - protein, 9 aa, Artificial Sequence
  Description of Artificial Sequence: Synthetic peptide
  Fab XENP19280, scFv XENP19818 vhCDR3
TGWLGPFDY

SEQ ID NO: 29478 - protein, 20 aa, Artificial Sequence
  Description of Artificial Sequence: Synthetic peptide
  Fab XENP19280, scFv XENP19818 scFv linker
GKPGSGKPGSGKPGSGKPGS

SEQ ID NO: 29479 - protein, 108 aa, Artificial Sequence; identical to SEQ ID NO: 3741
  Description of Artificial Sequence: Synthetic polypeptide
  VL of Fab XENP19280, scFv XENP19818

SEQ ID NO: 29480 - protein, 12 aa, Artificial Sequence
  Description of Artificial Sequence: Synthetic peptide
  Fab XENP19280, scFv XENP19818 vlCDR1
RASQSVGSSYLA

SEQ ID NO: 29481 - protein, 7 aa, Artificial Sequence
  Description of Artificial Sequence: Synthetic peptide
  Fab XENP19280, scFv XENP19818 vlCDR2
GAFSRAT

SEQ ID NO: 29482 - protein, 9 aa, Artificial Sequence
  Description of Artificial Sequence: Synthetic peptide
  Fab XENP19280, scFv XENP19818 vlCDR3
QQYGSSPWT

SEQ ID NO: 29483 - protein, 246 aa, Artificial Sequence; identical to SEQ ID NO: 5489
  Description of Artificial Sequence: Synthetic polypeptide
  Fab XENP19280, scFv XENP19818 scFv

SEQ ID NO: 29484 - protein, 118 aa, Artificial Sequence; identical to SEQ ID NO: 3737
  Description of Artificial Sequence: Synthetic polypeptide
  VH of Fab XENP19437, scFv XENP19910

SEQ ID NO: 29485 - protein, 5 aa, Artificial Sequence
  Description of Artificial Sequence: Synthetic peptide
  Fab XENP19437, scFv XENP19910 vhCDR1
SYTMH

SEQ ID NO: 29486 - protein, 17 aa, Artificial Sequence
  Description of Artificial Sequence: Synthetic peptide
  Fab XENP19437, scFv XENP19910 vhCDR2
FISYDGNNKYYADSVKG

SEQ ID NO: 29487 - protein, 9 aa, Artificial Sequence
  Description of Artificial Sequence: Synthetic peptide
  Fab XENP19437, scFv XENP19910 vhCDR3
TGWLGPFDY

SEQ ID NO: 29488 - protein, 20 aa, Artificial Sequence
  Description of Artificial Sequence: Synthetic peptide
  Fab XENP19437, scFv XENP19910 scFv linker
GKPGSGKPGSGKPGSGKPGS

SEQ ID NO: 29489 - protein, 108 aa, Artificial Sequence; identical to SEQ ID NO: 2411
  Description of Artificial Sequence: Synthetic polypeptide
  VL of Fab XENP19437, scFv XENP19910

SEQ ID NO: 29490 - protein, 12 aa, Artificial Sequence
  Description of Artificial Sequence: Synthetic peptide
  Fab XENP19437, scFv XENP19910 vlCDR1
RASQSVSSSYLA

SEQ ID NO: 29491 - protein, 7 aa, Artificial Sequence
  Description of Artificial Sequence: Synthetic peptide
  Fab XENP19437, scFv XENP19910 vlCDR2
GAFSRAT

SEQ ID NO: 29492 - protein, 9 aa, Artificial Sequence
  Description of Artificial Sequence: Synthetic peptide
  Fab XENP19437, scFv XENP19910 vlCDR3
QQYGSSPWT

SEQ ID NO: 29493 - protein, 246 aa, Artificial Sequence; identical to SEQ ID NO: 6281
  Description of Artificial Sequence: Synthetic polypeptide
  Fab XENP19437, scFv XENP19910 scFv

SEQ ID NO: 29494 - protein, 118 aa, Artificial Sequence; identical to SEQ ID NO: 4806
  Description of Artificial Sequence: Synthetic polypeptide
  VH of Fab XENP19545, scFv XENP19552

SEQ ID NO: 29495 - protein, 5 aa, Artificial Sequence
  Description of Artificial Sequence: Synthetic peptide
  Fab XENP19545, scFv XENP19552 vhCDR1
SYTMH

SEQ ID NO: 29496 - protein, 17 aa, Artificial Sequence
  Description of Artificial Sequence: Synthetic peptide
  Fab XENP19545, scFv XENP19552 vhCDR2
FISYDGNNKYYPGSVKG

SEQ ID NO: 29497 - protein, 9 aa, Artificial Sequence
  Description of Artificial Sequence: Synthetic peptide
  Fab XENP19545, scFv XENP19552 vhCDR3
TGWLGPFDY

SEQ ID NO: 29498 - protein, 20 aa, Artificial Sequence
  Description of Artificial Sequence: Synthetic peptide
  Fab XENP19545, scFv XENP19552 scFv linker
GKPGSGKPGSGKPGSGKPGS

SEQ ID NO: 29499 - protein, 108 aa, Artificial Sequence; identical to SEQ ID NO: 3741
  Description of Artificial Sequence: Synthetic polypeptide
  VL of Fab XENP19545, scFv XENP19552

SEQ ID NO: 29500 - protein, 12 aa, Artificial Sequence
  Description of Artificial Sequence: Synthetic peptide
  Fab XENP19545, scFv XENP19552 vlCDR1
RASQSVGSSYLA

SEQ ID NO: 29501 - protein, 7 aa, Artificial Sequence
  Description of Artificial Sequence: Synthetic peptide
  Fab XENP19545, scFv XENP19552 vlCDR2
GAFSRAT

SEQ ID NO: 29502 - protein, 9 aa, Artificial Sequence
  Description of Artificial Sequence: Synthetic peptide
  Fab XENP19545, scFv XENP19552 vlCDR3
QQYGSSPWT

SEQ ID NO: 29503 - protein, 246 aa, Artificial Sequence; identical to SEQ ID NO: 4805
  Description of Artificial Sequence: Synthetic polypeptide
  Fab XENP19545, scFv XENP19552 scFv

SEQ ID NO: 29504 - protein, 118 aa, Artificial Sequence; identical to SEQ ID NO: 7290
  Description of Artificial Sequence: Synthetic polypeptide
  VH of Fab XENP20422, scFv XENP20431

SEQ ID NO: 29505 - protein, 5 aa, Artificial Sequence
  Description of Artificial Sequence: Synthetic peptide
  Fab XENP20422, scFv XENP20431 vhCDR1
SYTMH

SEQ ID NO: 29506 - protein, 17 aa, Artificial Sequence
  Description of Artificial Sequence: Synthetic peptide
  Fab XENP20422, scFv XENP20431 vhCDR2
FISYDGNTKYYADSVKG

SEQ ID NO: 29507 - protein, 9 aa, Artificial Sequence
  Description of Artificial Sequence: Synthetic peptide
  Fab XENP20422, scFv XENP20431 vhCDR3
GGLLGPFDL

SEQ ID NO: 29508 - protein, 20 aa, Artificial Sequence
  Description of Artificial Sequence: Synthetic peptide
  Fab XENP20422, scFv XENP20431 scFv linker
GKPGSGKPGSGKPGSGKPGS

SEQ ID NO: 29509 - protein, 108 aa, Artificial Sequence; identical to SEQ ID NO: 7399
  Description of Artificial Sequence: Synthetic polypeptide
  VL of Fab XENP20422, scFv XENP20431

SEQ ID NO: 29510 - protein, 12 aa, Artificial Sequence
  Description of Artificial Sequence: Synthetic peptide
  Fab XENP20422, scFv XENP20431 vlCDR1
RASQSVGSSYLA

SEQ ID NO: 29511 - protein, 7 aa, Artificial Sequence
  Description of Artificial Sequence: Synthetic peptide
  Fab XENP20422, scFv XENP20431 vlCDR2
GASSRAT

SEQ ID NO: 29512 - protein, 9 aa, Artificial Sequence
  Description of Artificial Sequence: Synthetic peptide
  Fab XENP20422, scFv XENP20431 vlCDR3
QQYGSSPWT

SEQ ID NO: 29513 - protein, 246 aa, Artificial Sequence; identical to SEQ ID NO: 7514
  Description of Artificial Sequence: Synthetic polypeptide
  Fab XENP20422, scFv XENP20431 scFv

SEQ ID NO: 29514 - protein, 118 aa, Artificial Sequence; identical to SEQ ID NO: 7290
  Description of Artificial Sequence: Synthetic polypeptide
  VH of Fab XENP20423, scFv XENP20432

SEQ ID NO: 29515 - protein, 5 aa, Artificial Sequence
  Description of Artificial Sequence: Synthetic peptide
  Fab XENP20423, scFv XENP20432 vhCDR1
SYTMH

SEQ ID NO: 29516 - protein, 17 aa, Artificial Sequence
  Description of Artificial Sequence: Synthetic peptide
  Fab XENP20423, scFv XENP20432 vhCDR2
FISYDGNTKYYADSVKG

SEQ ID NO: 29517 - protein, 9 aa, Artificial Sequence
  Description of Artificial Sequence: Synthetic peptide
  Fab XENP20423, scFv XENP20432 vhCDR3
GGLLGPFDL

SEQ ID NO: 29518 - protein, 20 aa, Artificial Sequence
  Description of Artificial Sequence: Synthetic peptide
  Fab XENP20423, scFv XENP20432 scFv linker
GKPGSGKPGSGKPGSGKPGS

SEQ ID NO: 29519 - protein, 108 aa, Artificial Sequence; identical to SEQ ID NO: 2396
  Description of Artificial Sequence: Synthetic polypeptide
  VL of Fab XENP20423, scFv XENP20432

SEQ ID NO: 29520 - protein, 12 aa, Artificial Sequence
  Description of Artificial Sequence: Synthetic peptide
  Fab XENP20423, scFv XENP20432 vlCDR1
RASQSVGSSYLA

SEQ ID NO: 29521 - protein, 7 aa, Artificial Sequence
  Description of Artificial Sequence: Synthetic peptide
  Fab XENP20423, scFv XENP20432 vlCDR2
GASSRAT

SEQ ID NO: 29522 - protein, 9 aa, Artificial Sequence
  Description of Artificial Sequence: Synthetic peptide
  Fab XENP20423, scFv XENP20432 vlCDR3
QQYGSSPWT

SEQ ID NO: 29523 - protein, 246 aa, Artificial Sequence; identical to SEQ ID NO: 7523
  Description of Artificial Sequence: Synthetic polypeptide
  Fab XENP20423, scFv XENP20432 scFv

SEQ ID NO: 29524 - protein, 118 aa, Artificial Sequence; identical to SEQ ID NO: 7290
  Description of Artificial Sequence: Synthetic polypeptide
  VH of Fab XENP20424, scFv XENP20433

SEQ ID NO: 29525 - protein, 5 aa, Artificial Sequence
  Description of Artificial Sequence: Synthetic peptide
  Fab XENP20424, scFv XENP20433 vhCDR1
SYTMH

SEQ ID NO: 29526 - protein, 17 aa, Artificial Sequence
  Description of Artificial Sequence: Synthetic peptide
  Fab XENP20424, scFv XENP20433 vhCDR2
FISYDGNTKYYADSVKG

SEQ ID NO: 29527 - protein, 9 aa, Artificial Sequence
  Description of Artificial Sequence: Synthetic peptide
  Fab XENP20424, scFv XENP20433 vhCDR3
GGLLGPFDL

SEQ ID NO: 29528 - protein, 20 aa, Artificial Sequence
  Description of Artificial Sequence: Synthetic peptide
  Fab XENP20424, scFv XENP20433 scFv linker
GKPGSGKPGSGKPGSGKPGS

SEQ ID NO: 29529 - protein, 108 aa, Artificial Sequence; identical to SEQ ID NO: 7471
  Description of Artificial Sequence: Synthetic polypeptide
  VL of Fab XENP20424, scFv XENP20433

SEQ ID NO: 29530 - protein, 12 aa, Artificial Sequence
  Description of Artificial Sequence: Synthetic peptide
  Fab XENP20424, scFv XENP20433 vlCDR1
RASQSVSSSYLA

SEQ ID NO: 29531 - protein, 7 aa, Artificial Sequence
  Description of Artificial Sequence: Synthetic peptide
  Fab XENP20424, scFv XENP20433 vlCDR2
GASSRAT

SEQ ID NO: 29532 - protein, 9 aa, Artificial Sequence
  Description of Artificial Sequence: Synthetic peptide
  Fab XENP20424, scFv XENP20433 vlCDR3
QQYGSSPWT

SEQ ID NO: 29533 - protein, 246 aa, Artificial Sequence; identical to SEQ ID NO: 7532
  Description of Artificial Sequence: Synthetic polypeptide
  Fab XENP20424, scFv XENP20433 scFv

SEQ ID NO: 29534 - protein, 118 aa, Artificial Sequence; identical to SEQ ID NO: 2395
  Description of Artificial Sequence: Synthetic polypeptide
  VH of Fab XENP20425, scFv XENP20434

SEQ ID NO: 29535 - protein, 5 aa, Artificial Sequence
  Description of Artificial Sequence: Synthetic peptide
  Fab XENP20425, scFv XENP20434 vhCDR1
SYTMH

SEQ ID NO: 29536 - protein, 17 aa, Artificial Sequence
  Description of Artificial Sequence: Synthetic peptide
  Fab XENP20425, scFv XENP20434 vhCDR2
FISYDGNYKYYADSVKG

SEQ ID NO: 29537 - protein, 9 aa, Artificial Sequence
  Description of Artificial Sequence: Synthetic peptide
  Fab XENP20425, scFv XENP20434 vhCDR3
GGHLGPFDL

SEQ ID NO: 29538 - protein, 20 aa, Artificial Sequence
  Description of Artificial Sequence: Synthetic peptide
  Fab XENP20425, scFv XENP20434 scFv linker
GKPGSGKPGSGKPGSGKPGS

SEQ ID NO: 29539 - protein, 108 aa, Artificial Sequence; identical to SEQ ID NO: 7399
  Description of Artificial Sequence: Synthetic polypeptide
  VL of Fab XENP20425, scFv XENP20434

SEQ ID NO: 29540 - protein, 12 aa, Artificial Sequence
  Description of Artificial Sequence: Synthetic peptide
  Fab XENP20425, scFv XENP20434 vlCDR1
RASQSVGSSYLA

SEQ ID NO: 29541 - protein, 7 aa, Artificial Sequence
  Description of Artificial Sequence: Synthetic peptide
  Fab XENP20425, scFv XENP20434 vlCDR2
GASSRAT

SEQ ID NO: 29542 - protein, 9 aa, Artificial Sequence
  Description of Artificial Sequence: Synthetic peptide
  Fab XENP20425, scFv XENP20434 vlCDR3
QQYGSSPWT

SEQ ID NO: 29543 - protein, 246 aa, Artificial Sequence; identical to SEQ ID NO: 7541
  Description of Artificial Sequence: Synthetic polypeptide
  Fab XENP20425, scFv XENP20434 scFv

SEQ ID NO: 29544 - protein, 118 aa, Artificial Sequence; identical to SEQ ID NO: 2395
  Description of Artificial Sequence: Synthetic polypeptide
  VH of Fab XENP20426, scFv XENP20435

SEQ ID NO: 29545 - protein, 5 aa, Artificial Sequence
  Description of Artificial Sequence: Synthetic peptide
  Fab XENP20426, scFv XENP20435 vhCDR1
SYTMH

SEQ ID NO: 29546 - protein, 17 aa, Artificial Sequence
  Description of Artificial Sequence: Synthetic peptide
  Fab XENP20426, scFv XENP20435 vhCDR2
FISYDGNYKYYADSVKG

SEQ ID NO: 29547 - protein, 9 aa, Artificial Sequence
  Description of Artificial Sequence: Synthetic peptide
  Fab XENP20426, scFv XENP20435 vhCDR3
GGHLGPFDL

SEQ ID NO: 29548 - protein, 20 aa, Artificial Sequence
  Description of Artificial Sequence: Synthetic peptide
  Fab XENP20426, scFv XENP20435 scFv linker
GKPGSGKPGSGKPGSGKPGS

SEQ ID NO: 29549 - protein, 108 aa, Artificial Sequence; identical to SEQ ID NO: 2396
  Description of Artificial Sequence: Synthetic polypeptide
  VL of Fab XENP20426, scFv XENP20435

SEQ ID NO: 29550 - protein, 12 aa, Artificial Sequence
  Description of Artificial Sequence: Synthetic peptide
  Fab XENP20426, scFv XENP20435 vlCDR1
RASQSVGSSYLA

SEQ ID NO: 29551 - protein, 7 aa, Artificial Sequence
  Description of Artificial Sequence: Synthetic peptide
  Fab XENP20426, scFv XENP20435 vlCDR2
GASSRAT

SEQ ID NO: 29552 - protein, 9 aa, Artificial Sequence
  Description of Artificial Sequence: Synthetic peptide
  Fab XENP20426, scFv XENP20435 vlCDR3
QQYGSSPWT

SEQ ID NO: 29553 - protein, 246 aa, Artificial Sequence; identical to SEQ ID NO: 7550
  Description of Artificial Sequence: Synthetic polypeptide
  Fab XENP20426, scFv XENP20435 scFv

SEQ ID NO: 29554 - protein, 118 aa, Artificial Sequence; identical to SEQ ID NO: 2395
  Description of Artificial Sequence: Synthetic polypeptide
  VH of Fab XENP20427, scFv XENP20436

SEQ ID NO: 29555 - protein, 5 aa, Artificial Sequence
  Description of Artificial Sequence: Synthetic peptide
  Fab XENP20427, scFv XENP20436 vhCDR1
SYTMH

SEQ ID NO: 29556 - protein, 17 aa, Artificial Sequence
  Description of Artificial Sequence: Synthetic peptide
  Fab XENP20427, scFv XENP20436 vhCDR2
FISYDGNYKYYADSVKG

SEQ ID NO: 29557 - protein, 9 aa, Artificial Sequence
  Description of Artificial Sequence: Synthetic peptide
  Fab XENP20427, scFv XENP20436 vhCDR3
GGHLGPFDL

SEQ ID NO: 29558 - protein, 20 aa, Artificial Sequence
  Description of Artificial Sequence: Synthetic peptide
  Fab XENP20427, scFv XENP20436 scFv linker
GKPGSGKPGSGKPGSGKPGS

SEQ ID NO: 29559 - protein, 108 aa, Artificial Sequence; identical to SEQ ID NO: 7471
  Description of Artificial Sequence: Synthetic polypeptide
  VL of Fab XENP20427, scFv XENP20436

SEQ ID NO: 29560 - protein, 12 aa, Artificial Sequence
  Description of Artificial Sequence: Synthetic peptide
  Fab XENP20427, scFv XENP20436 vlCDR1
RASQSVSSSYLA

SEQ ID NO: 29561 - protein, 7 aa, Artificial Sequence
  Description of Artificial Sequence: Synthetic peptide
  Fab XENP20427, scFv XENP20436 vlCDR2
GASSRAT

SEQ ID NO: 29562 - protein, 9 aa, Artificial Sequence
  Description of Artificial Sequence: Synthetic peptide
  Fab XENP20427, scFv XENP20436 vlCDR3
QQYGSSPWT

SEQ ID NO: 29563 - protein, 246 aa, Artificial Sequence; identical to SEQ ID NO: 7559
  Description of Artificial Sequence: Synthetic polypeptide
  Fab XENP20427, scFv XENP20436 scFv

SEQ ID NO: 29564 - protein, 118 aa, Artificial Sequence; identical to SEQ ID NO: 7326
  Description of Artificial Sequence: Synthetic polypeptide
  VH of Fab XENP20428, scFv XENP20437

SEQ ID NO: 29565 - protein, 5 aa, Artificial Sequence
  Description of Artificial Sequence: Synthetic peptide
  Fab XENP20428, scFv XENP20437 vhCDR1
SYTMH

SEQ ID NO: 29566 - protein, 17 aa, Artificial Sequence
  Description of Artificial Sequence: Synthetic peptide
  Fab XENP20428, scFv XENP20437 vhCDR2
FISYDGNYKYYADSVKG

SEQ ID NO: 29567 - protein, 9 aa, Artificial Sequence
  Description of Artificial Sequence: Synthetic peptide
  Fab XENP20428, scFv XENP20437 vhCDR3
GGLLGPFDL

SEQ ID NO: 29568 - protein, 20 aa, Artificial Sequence
  Description of Artificial Sequence: Synthetic peptide
  Fab XENP20428, scFv XENP20437 scFv linker
GKPGSGKPGSGKPGSGKPGS

SEQ ID NO: 29569 - protein, 108 aa, Artificial Sequence; identical to SEQ ID NO: 7399
  Description of Artificial Sequence: Synthetic polypeptide
  VL of Fab XENP20428, scFv XENP20437

SEQ ID NO: 29570 - protein, 12 aa, Artificial Sequence
  Description of Artificial Sequence: Synthetic peptide
  Fab XENP20428, scFv XENP20437 vlCDR1
RASQSVGSSYLA

SEQ ID NO: 29571 - protein, 7 aa, Artificial Sequence
  Description of Artificial Sequence: Synthetic peptide
  Fab XENP20428, scFv XENP20437 vlCDR2
GASSRAT

SEQ ID NO: 29572 - protein, 9 aa, Artificial Sequence
  Description of Artificial Sequence: Synthetic peptide
  Fab XENP20428, scFv XENP20437 vlCDR3
QQYGSSPWT

SEQ ID NO: 29573 - protein, 246 aa, Artificial Sequence; identical to SEQ ID NO: 7568
  Description of Artificial Sequence: Synthetic polypeptide
  Fab XENP20428, scFv XENP20437 scFv

SEQ ID NO: 29574 - protein, 118 aa, Artificial Sequence; identical to SEQ ID NO: 7326
  Description of Artificial Sequence: Synthetic polypeptide
  VH of Fab XENP20429, scFv XENP20438

SEQ ID NO: 29575 - protein, 5 aa, Artificial Sequence
  Description of Artificial Sequence: Synthetic peptide
  Fab XENP20429, scFv XENP20438 vhCDR1
SYTMH

SEQ ID NO: 29576 - protein, 17 aa, Artificial Sequence
  Description of Artificial Sequence: Synthetic peptide
  Fab XENP20429, scFv XENP20438 vhCDR2
FISYDGNYKYYADSVKG

SEQ ID NO: 29577 - protein, 9 aa, Artificial Sequence
  Description of Artificial Sequence: Synthetic peptide
  Fab XENP20429, scFv XENP20438 vhCDR3
GGLLGPFDL

SEQ ID NO: 29578 - protein, 20 aa, Artificial Sequence
  Description of Artificial Sequence: Synthetic peptide
  Fab XENP20429, scFv XENP20438 scFv linker
GKPGSGKPGSGKPGSGKPGS

SEQ ID NO: 29579 - protein, 108 aa, Artificial Sequence; identical to SEQ ID NO: 2396
  Description of Artificial Sequence: Synthetic polypeptide
  VL of Fab XENP20429, scFv XENP20438

SEQ ID NO: 29580 - protein, 12 aa, Artificial Sequence
  Description of Artificial Sequence: Synthetic peptide
  Fab XENP20429, scFv XENP20438 vlCDR1
RASQSVGSSYLA

SEQ ID NO: 29581 - protein, 7 aa, Artificial Sequence
  Description of Artificial Sequence: Synthetic peptide
  Fab XENP20429, scFv XENP20438 vlCDR2
GASSRAT

SEQ ID NO: 29582 - protein, 9 aa, Artificial Sequence
  Description of Artificial Sequence: Synthetic peptide
  Fab XENP20429, scFv XENP20438 vlCDR3
QQYGSSPWT

SEQ ID NO: 29583 - protein, 246 aa, Artificial Sequence; identical to SEQ ID NO: 7577
  Description of Artificial Sequence: Synthetic polypeptide
  Fab XENP20429, scFv XENP20438 scFv

SEQ ID NO: 29584 - protein, 118 aa, Artificial Sequence; identical to SEQ ID NO: 7326
  Description of Artificial Sequence: Synthetic polypeptide
  VH of Fab XENP20430, scFv XENP20439

SEQ ID NO: 29585 - protein, 5 aa, Artificial Sequence
  Description of Artificial Sequence: Synthetic peptide
  Fab XENP20430, scFv XENP20439 vhCDR1
SYTMH

SEQ ID NO: 29586 - protein, 17 aa, Artificial Sequence
  Description of Artificial Sequence: Synthetic peptide
  Fab XENP20430, scFv XENP20439 vhCDR2
FISYDGNYKYYADSVKG

SEQ ID NO: 29587 - protein, 9 aa, Artificial Sequence
  Description of Artificial Sequence: Synthetic peptide
  Fab XENP20430, scFv XENP20439 vhCDR3
GGLLGPFDL

SEQ ID NO: 29588 - protein, 20 aa, Artificial Sequence
  Description of Artificial Sequence: Synthetic peptide
  Fab XENP20430, scFv XENP20439 scFv linker
GKPGSGKPGSGKPGSGKPGS

SEQ ID NO: 29589 - protein, 108 aa, Artificial Sequence; identical to SEQ ID NO: 7471
  Description of Artificial Sequence: Synthetic polypeptide
  VL of Fab XENP20430, scFv XENP20439

SEQ ID NO: 29590 - protein, 12 aa, Artificial Sequence
  Description of Artificial Sequence: Synthetic peptide
  Fab XENP20430, scFv XENP20439 vlCDR1
RASQSVSSSYLA

SEQ ID NO: 29591 - protein, 7 aa, Artificial Sequence
  Description of Artificial Sequence: Synthetic peptide
  Fab XENP20430, scFv XENP20439 vlCDR2
GASSRAT

SEQ ID NO: 29592 - protein, 9 aa, Artificial Sequence
  Description of Artificial Sequence: Synthetic peptide
  Fab XENP20430, scFv XENP20439 vlCDR3
QQYGSSPWT

SEQ ID NO: 29593 - protein, 246 aa, Artificial Sequence; identical to SEQ ID NO: 7586
  Description of Artificial Sequence: Synthetic polypeptide
  Fab XENP20430, scFv XENP20439 scFv

SEQ ID NO: 29594 - protein, 118 aa, Artificial Sequence; identical to SEQ ID NO: 7137
  Description of Artificial Sequence: Synthetic polypeptide
  VH of Fab XENP20341, scFv XENP20378

SEQ ID NO: 29595 - protein, 6 aa, Artificial Sequence
  Description of Artificial Sequence: Synthetic peptide
  Fab XENP20341, scFv XENP20378 vhCDR1
SSYTMH

SEQ ID NO: 29596 - protein, 17 aa, Artificial Sequence
  Description of Artificial Sequence: Synthetic peptide
  Fab XENP20341, scFv XENP20378 vhCDR2
FISYDGNHKYYADSVKG

SEQ ID NO: 29597 - protein, 9 aa, Artificial Sequence
  Description of Artificial Sequence: Synthetic peptide
  Fab XENP20341, scFv XENP20378 vhCDR3
TGHLGPFDL

SEQ ID NO: 29598 - protein, 20 aa, Artificial Sequence
  Description of Artificial Sequence: Synthetic peptide
  Fab XENP20341, scFv XENP20378 scFv linker
GKPGSGKPGSGKPGSGKPGS

SEQ ID NO: 29599 - protein, 108 aa, Artificial Sequence; identical to SEQ ID NO: 7345
  Description of Artificial Sequence: Synthetic polypeptide
  VL of Fab XENP20341, scFv XENP20378

SEQ ID NO: 29600 - protein, 12 aa, Artificial Sequence
  Description of Artificial Sequence: Synthetic peptide
  Fab XENP20341, scFv XENP20378 vlCDR1
RASQSVGSSYLA

SEQ ID NO: 29601 - protein, 7 aa, Artificial Sequence
  Description of Artificial Sequence: Synthetic peptide
  Fab XENP20341, scFv XENP20378 vlCDR2
GAFSRAT

SEQ ID NO: 29602 - protein, 9 aa, Artificial Sequence
  Description of Artificial Sequence: Synthetic peptide
  Fab XENP20341, scFv XENP20378 vlCDR3
QQYGSSPWT

SEQ ID NO: 29603 - protein, 246 aa, Artificial Sequence; identical to SEQ ID NO: 7343
  Description of Artificial Sequence: Synthetic polypeptide
  Fab XENP20341, scFv XENP20378 scFv

SEQ ID NO: 29604 - protein, 118 aa, Artificial Sequence; identical to SEQ ID NO: 7137
  Description of Artificial Sequence: Synthetic polypeptide
  VH of Fab XENP20342, scFv XENP20379

SEQ ID NO: 29605 - protein, 5 aa, Artificial Sequence
  Description of Artificial Sequence: Synthetic peptide
  Fab XENP20342, scFv XENP20379 vhCDR1
SYTMH

SEQ ID NO: 29606 - protein, 17 aa, Artificial Sequence
  Description of Artificial Sequence: Synthetic peptide
  Fab XENP20342, scFv XENP20379 vhCDR2
FISYDGNHKYYADSVKG

SEQ ID NO: 29607 - protein, 9 aa, Artificial Sequence
  Description of Artificial Sequence: Synthetic peptide
  Fab XENP20342, scFv XENP20379 vhCDR3
TGHLGPFDL

SEQ ID NO: 29608 - protein, 20 aa, Artificial Sequence
  Description of Artificial Sequence: Synthetic peptide
  Fab XENP20342, scFv XENP20379 scFv linker
GKPGSGKPGSGKPGSGKPGS

SEQ ID NO: 29609 - protein, 108 aa, Artificial Sequence; identical to SEQ ID NO: 3741
  Description of Artificial Sequence: Synthetic polypeptide
  VL of Fab XENP20342, scFv XENP20379

SEQ ID NO: 29610 - protein, 12 aa, Artificial Sequence
  Description of Artificial Sequence: Synthetic peptide
  Fab XENP20342, scFv XENP20379 vlCDR1
RASQSVGSSYLA

SEQ ID NO: 29611 - protein, 7 aa, Artificial Sequence
  Description of Artificial Sequence: Synthetic peptide
  Fab XENP20342, scFv XENP20379 vlCDR2
GAFSRAT

SEQ ID NO: 29612 - protein, 9 aa, Artificial Sequence
  Description of Artificial Sequence: Synthetic peptide
  Fab XENP20342, scFv XENP20379 vlCDR3
QQYGSSPWT

SEQ ID NO: 29613 - protein, 246 aa, Artificial Sequence; identical to SEQ ID NO: 7352
  Description of Artificial Sequence: Synthetic polypeptide
  Fab XENP20342, scFv XENP20379 scFv

SEQ ID NO: 29614 - protein, 118 aa, Artificial Sequence; identical to SEQ ID NO: 7137
  Description of Artificial Sequence: Synthetic polypeptide
  VH of Fab XENP20071, scFv XENP20078

SEQ ID NO: 29615 - protein, 5 aa, Artificial Sequence
  Description of Artificial Sequence: Synthetic peptide
  Fab XENP20071, scFv XENP20078 vhCDR1
SYTMH

SEQ ID NO: 29616 - protein, 17 aa, Artificial Sequence
  Description of Artificial Sequence: Synthetic peptide
  Fab XENP20071, scFv XENP20078 vhCDR2
FISYDGNHKYYADSVKG

SEQ ID NO: 29617 - protein, 9 aa, Artificial Sequence
  Description of Artificial Sequence: Synthetic peptide
  Fab XENP20071, scFv XENP20078 vhCDR3
TGHLGPFDL

SEQ ID NO: 29618 - protein, 20 aa, Artificial Sequence
  Description of Artificial Sequence: Synthetic peptide
  Fab XENP20071, scFv XENP20078 scFv linker
GKPGSGKPGSGKPGSGKPGS

SEQ ID NO: 29619 - protein, 108 aa, Artificial Sequence; identical to SEQ ID NO: 6193
  Description of Artificial Sequence: Synthetic polypeptide
  VL of Fab XENP20071, scFv XENP20078

SEQ ID NO: 29620 - protein, 12 aa, Artificial Sequence
  Description of Artificial Sequence: Synthetic peptide
  Fab XENP20071, scFv XENP20078 vlCDR1
RASQSVGSSYLA

SEQ ID NO: 29621 - protein, 7 aa, Artificial Sequence
  Description of Artificial Sequence: Synthetic peptide
  Fab XENP20071, scFv XENP20078 vlCDR2
GAFSRAT

SEQ ID NO: 29622 - protein, 9 aa, Artificial Sequence
  Description of Artificial Sequence: Synthetic peptide
  Fab XENP20071, scFv XENP20078 vlCDR3
QQYGSSPWT

SEQ ID NO: 29623 - protein, 246 aa, Artificial Sequence; identical to SEQ ID NO: 7136
  Description of Artificial Sequence: Synthetic polypeptide
  Fab XENP20071, scFv XENP20078 scFv

SEQ ID NO: 29624 - protein, 118 aa, Artificial Sequence; identical to SEQ ID NO: 7137
  Description of Artificial Sequence: Synthetic polypeptide
  VH of Fab XENP20344, scFv XENP20381

SEQ ID NO: 29625 - protein, 5 aa, Artificial Sequence
  Description of Artificial Sequence: Synthetic peptide
  Fab XENP20344, scFv XENP20381 vhCDR1
SYTMH

SEQ ID NO: 29626 - protein, 17 aa, Artificial Sequence
  Description of Artificial Sequence: Synthetic peptide
  Fab XENP20344, scFv XENP20381 vhCDR2
FISYDGNHKYYADSVKG

SEQ ID NO: 29627 - protein, 9 aa, Artificial Sequence
  Description of Artificial Sequence: Synthetic peptide
  Fab XENP20344, scFv XENP20381 vhCDR3
TGHLGPFDL

SEQ ID NO: 29628 - protein, 20 aa, Artificial Sequence
  Description of Artificial Sequence: Synthetic peptide
  Fab XENP20344, scFv XENP20381 scFv linker
GKPGSGKPGSGKPGSGKPGS

SEQ ID NO: 29629 - protein, 108 aa, Artificial Sequence; identical to SEQ ID NO: 7372
  Description of Artificial Sequence: Synthetic polypeptide
  VL of Fab XENP20344, scFv XENP20381

SEQ ID NO: 29630 - protein, 12 aa, Artificial Sequence
  Description of Artificial Sequence: Synthetic peptide
  Fab XENP20344, scFv XENP20381 vlCDR1
RASQSVGSSYLA

SEQ ID NO: 29631 - protein, 7 aa, Artificial Sequence
  Description of Artificial Sequence: Synthetic peptide
  Fab XENP20344, scFv XENP20381 vlCDR2
GASSRAT

SEQ ID NO: 29632 - protein, 9 aa, Artificial Sequence
  Description of Artificial Sequence: Synthetic peptide
  Fab XENP20344, scFv XENP20381 vlCDR3
QQYGSSPWT

SEQ ID NO: 29633 - protein, 246 aa, Artificial Sequence; identical to SEQ ID NO: 7370
  Description of Artificial Sequence: Synthetic polypeptide
  Fab XENP20344, scFv XENP20381 scFv

SEQ ID NO: 29634 - protein, 118 aa, Artificial Sequence; identical to SEQ ID NO: 7137
  Description of Artificial Sequence: Synthetic polypeptide
  VH of Fab XENP20345, scFv XENP20382

SEQ ID NO: 29635 - protein, 5 aa, Artificial Sequence
  Description of Artificial Sequence: Synthetic peptide
  Fab XENP20345, scFv XENP20382 vhCDR1
SYTMH

SEQ ID NO: 29636 - protein, 17 aa, Artificial Sequence
  Description of Artificial Sequence: Synthetic peptide
  Fab XENP20345, scFv XENP20382 vhCDR2
FISYDGNHKYYADSVKG

SEQ ID NO: 29637 - protein, 9 aa, Artificial Sequence
  Description of Artificial Sequence: Synthetic peptide
  Fab XENP20345, scFv XENP20382 vhCDR3
TGHLGPFDL

SEQ ID NO: 29638 - protein, 20 aa, Artificial Sequence
  Description of Artificial Sequence: Synthetic peptide
  Fab XENP20345, scFv XENP20382 scFv linker
GKPGSGKPGSGKPGSGKPGS

SEQ ID NO: 29639 - protein, 108 aa, Artificial Sequence; identical to SEQ ID NO: 6157
  Description of Artificial Sequence: Synthetic polypeptide
  VL of Fab XENP20345, scFv XENP20382

SEQ ID NO: 29640 - protein, 12 aa, Artificial Sequence
  Description of Artificial Sequence: Synthetic peptide
  Fab XENP20345, scFv XENP20382 vlCDR1
RASQSVGSSYLA

SEQ ID NO: 29641 - protein, 7 aa, Artificial Sequence
  Description of Artificial Sequence: Synthetic peptide
  Fab XENP20345, scFv XENP20382 vlCDR2
GAFSRAT

SEQ ID NO: 29642 - protein, 9 aa, Artificial Sequence
  Description of Artificial Sequence: Synthetic peptide
  Fab XENP20345, scFv XENP20382 vlCDR3
QQYGSSPWT

SEQ ID NO: 29643 - protein, 246 aa, Artificial Sequence; identical to SEQ ID NO: 7379
  Description of Artificial Sequence: Synthetic polypeptide
  Fab XENP20345, scFv XENP20382 scFv

SEQ ID NO: 29644 - protein, 118 aa, Artificial Sequence; identical to SEQ ID NO: 7137
  Description of Artificial Sequence: Synthetic polypeptide
  VH of Fab XENP20346, scFv XENP20383

SEQ ID NO: 29645 - protein, 5 aa, Artificial Sequence
  Description of Artificial Sequence: Synthetic peptide
  Fab XENP20346, scFv XENP20383 vhCDR1
SYTMH

SEQ ID NO: 29646 - protein, 17 aa, Artificial Sequence
  Description of Artificial Sequence: Synthetic peptide
  Fab XENP20346, scFv XENP20383 vhCDR2
FISYDGNHKYYADSVKG

SEQ ID NO: 29647 - protein, 9 aa, Artificial Sequence
  Description of Artificial Sequence: Synthetic peptide
  Fab XENP20346, scFv XENP20383 vhCDR3
TGHLGPFDL

SEQ ID NO: 29648 - protein, 20 aa, Artificial Sequence
  Description of Artificial Sequence: Synthetic peptide
  Fab XENP20346, scFv XENP20383 scFv linker
GKPGSGKPGSGKPGSGKPGS

SEQ ID NO: 29649 - protein, 108 aa, Artificial Sequence; identical to SEQ ID NO: 7390
  Description of Artificial Sequence: Synthetic polypeptide
  VL of Fab XENP20346, scFv XENP20383

SEQ ID NO: 29650 - protein, 12 aa, Artificial Sequence
  Description of Artificial Sequence: Synthetic peptide
  Fab XENP20346, scFv XENP20383 vlCDR1
RASQSVSSSYLA

SEQ ID NO: 29651 - protein, 7 aa, Artificial Sequence
  Description of Artificial Sequence: Synthetic peptide
  Fab XENP20346, scFv XENP20383 vlCDR2
GAFSRAT

SEQ ID NO: 29652 - protein, 9 aa, Artificial Sequence
  Description of Artificial Sequence: Synthetic peptide
  Fab XENP20346, scFv XENP20383 vlCDR3
QQYGSSPWT

SEQ ID NO: 29653 - protein, 246 aa, Artificial Sequence; identical to SEQ ID NO: 7388
  Description of Artificial Sequence: Synthetic polypeptide
  Fab XENP20346, scFv XENP20383 scFv

SEQ ID NO: 29654 - protein, 118 aa, Artificial Sequence; identical to SEQ ID NO: 7137
  Description of Artificial Sequence: Synthetic polypeptide
  VH of Fab XENP20347, scFv XENP20384

SEQ ID NO: 29655 - protein, 5 aa, Artificial Sequence
  Description of Artificial Sequence: Synthetic peptide
  Fab XENP20347, scFv XENP20384 vhCDR1
SYTMH

SEQ ID NO: 29656 - protein, 17 aa, Artificial Sequence
  Description of Artificial Sequence: Synthetic peptide
  Fab XENP20347, scFv XENP20384 vhCDR2
FISYDGNHKYYADSVKG

SEQ ID NO: 29657 - protein, 9 aa, Artificial Sequence
  Description of Artificial Sequence: Synthetic peptide
  Fab XENP20347, scFv XENP20384 vhCDR3
TGHLGPFDL

SEQ ID NO: 29658 - protein, 20 aa, Artificial Sequence
  Description of Artificial Sequence: Synthetic peptide
  Fab XENP20347, scFv XENP20384 scFv linker
GKPGSGKPGSGKPGSGKPGS

SEQ ID NO: 29659 - protein, 108 aa, Artificial Sequence; identical to SEQ ID NO: 7399
  Description of Artificial Sequence: Synthetic polypeptide
  VL of Fab XENP20347, scFv XENP20384

SEQ ID NO: 29660 - protein, 12 aa, Artificial Sequence
  Description of Artificial Sequence: Synthetic peptide
  Fab XENP20347, scFv XENP20384 vlCDR1
RASQSVGSSYLA

SEQ ID NO: 29661 - protein, 7 aa, Artificial Sequence
  Description of Artificial Sequence: Synthetic peptide
  Fab XENP20347, scFv XENP20384 vlCDR2
GASSRAT

SEQ ID NO: 29662 - protein, 9 aa, Artificial Sequence
  Description of Artificial Sequence: Synthetic peptide
  Fab XENP20347, scFv XENP20384 vlCDR3
QQYGSSPWT

SEQ ID NO: 29663 - protein, 246 aa, Artificial Sequence; identical to SEQ ID NO: 7397
  Description of Artificial Sequence: Synthetic polypeptide
  Fab XENP20347, scFv XENP20384 scFv

SEQ ID NO: 29664 - protein, 118 aa, Artificial Sequence; identical to SEQ ID NO: 7137
  Description of Artificial Sequence: Synthetic polypeptide
  VH of Fab XENP20348, scFv XENP20385

SEQ ID NO: 29665 - protein, 5 aa, Artificial Sequence
  Description of Artificial Sequence: Synthetic peptide
  Fab XENP20348, scFv XENP20385 vhCDR1
SYTMH

SEQ ID NO: 29666 - protein, 17 aa, Artificial Sequence
  Description of Artificial Sequence: Synthetic peptide
  Fab XENP20348, scFv XENP20385 vhCDR2
FISYDGNHKYYADSVKG

SEQ ID NO: 29667 - protein, 9 aa, Artificial Sequence
  Description of Artificial Sequence: Synthetic peptide
  Fab XENP20348, scFv XENP20385 vhCDR3
TGHLGPFDL

SEQ ID NO: 29668 - protein, 20 aa, Artificial Sequence
  Description of Artificial Sequence: Synthetic peptide
  Fab XENP20348, scFv XENP20385 scFv linker
GKPGSGKPGSGKPGSGKPGS

SEQ ID NO: 29669 - protein, 108 aa, Artificial Sequence; identical to SEQ ID NO: 2411
  Description of Artificial Sequence: Synthetic polypeptide
  VL of Fab XENP20348, scFv XENP20385

SEQ ID NO: 29670 - protein, 12 aa, Artificial Sequence
  Description of Artificial Sequence: Synthetic peptide
  Fab XENP20348, scFv XENP20385 vlCDR1
RASQSVSSSYLA

SEQ ID NO: 29671 - protein, 7 aa, Artificial Sequence
  Description of Artificial Sequence: Synthetic peptide
  Fab XENP20348, scFv XENP20385 vlCDR2
GAFSRAT

SEQ ID NO: 29672 - protein, 9 aa, Artificial Sequence
  Description of Artificial Sequence: Synthetic peptide
  Fab XENP20348, scFv XENP20385 vlCDR3
QQYGSSPWT

SEQ ID NO: 29673 - protein, 246 aa, Artificial Sequence; identical to SEQ ID NO: 7406
  Description of Artificial Sequence: Synthetic polypeptide
  Fab XENP20348, scFv XENP20385 scFv

SEQ ID NO: 29674 - protein, 118 aa, Artificial Sequence; identical to SEQ ID NO: 7137
  Description of Artificial Sequence: Synthetic polypeptide
  VH of Fab XENP20349, scFv XENP20386

SEQ ID NO: 29675 - protein, 5 aa, Artificial Sequence
  Description of Artificial Sequence: Synthetic peptide
  Fab XENP20349, scFv XENP20386 vhCDR1
SYTMH

SEQ ID NO: 29676 - protein, 17 aa, Artificial Sequence
  Description of Artificial Sequence: Synthetic peptide
  Fab XENP20349, scFv XENP20386 vhCDR2
FISYDGNHKYYADSVKG

SEQ ID NO: 29677 - protein, 9 aa, Artificial Sequence
  Description of Artificial Sequence: Synthetic peptide
  Fab XENP20349, scFv XENP20386 vhCDR3
TGHLGPFDL

SEQ ID NO: 29678 - protein, 20 aa, Artificial Sequence
  Description of Artificial Sequence: Synthetic peptide
  Fab XENP20349, scFv XENP20386 scFv linker
GKPGSGKPGSGKPGSGKPGS

SEQ ID NO: 29679 - protein, 108 aa, Artificial Sequence; identical to SEQ ID NO: 6742
  Description of Artificial Sequence: Synthetic polypeptide
  VL of Fab XENP20349, scFv XENP20386

SEQ ID NO: 29680 - protein, 12 aa, Artificial Sequence
  Description of Artificial Sequence: Synthetic peptide
  Fab XENP20349, scFv XENP20386 vlCDR1
RASQSVGSSYLA

SEQ ID NO: 29681 - protein, 7 aa, Artificial Sequence
  Description of Artificial Sequence: Synthetic peptide
  Fab XENP20349, scFv XENP20386 vlCDR2
GASSRAT

SEQ ID NO: 29682 - protein, 9 aa, Artificial Sequence
  Description of Artificial Sequence: Synthetic peptide
  Fab XENP20349, scFv XENP20386 vlCDR3
QQYGSSPWT

SEQ ID NO: 29683 - protein, 246 aa, Artificial Sequence; identical to SEQ ID NO: 7415
  Description of Artificial Sequence: Synthetic polypeptide
  Fab XENP20349, scFv XENP20386 scFv

SEQ ID NO: 29684 - protein, 118 aa, Artificial Sequence; identical to SEQ ID NO: 7137
  Description of Artificial Sequence: Synthetic polypeptide
  VH of Fab XENP20350, scFv XENP20387

SEQ ID NO: 29685 - protein, 5 aa, Artificial Sequence
  Description of Artificial Sequence: Synthetic peptide
  Fab XENP20350, scFv XENP20387 vhCDR1
SYTMH

SEQ ID NO: 29686 - protein, 17 aa, Artificial Sequence
  Description of Artificial Sequence: Synthetic peptide
  Fab XENP20350, scFv XENP20387 vhCDR2
FISYDGNHKYYADSVKG

SEQ ID NO: 29687 - protein, 9 aa, Artificial Sequence
  Description of Artificial Sequence: Synthetic peptide
  Fab XENP20350, scFv XENP20387 vhCDR3
TGHLGPFDL

SEQ ID NO: 29688 - protein, 20 aa, Artificial Sequence
  Description of Artificial Sequence: Synthetic peptide
  Fab XENP20350, scFv XENP20387 scFv linker
GKPGSGKPGSGKPGSGKPGS

SEQ ID NO: 29689 - protein, 108 aa, Artificial Sequence; identical to SEQ ID NO: 7426
  Description of Artificial Sequence: Synthetic polypeptide
  VL of Fab XENP20350, scFv XENP20387

SEQ ID NO: 29690 - protein, 12 aa, Artificial Sequence
  Description of Artificial Sequence: Synthetic peptide
  Fab XENP20350, scFv XENP20387 vlCDR1
RASQSVSSSYLA

SEQ ID NO: 29691 - protein, 7 aa, Artificial Sequence
  Description of Artificial Sequence: Synthetic peptide
  Fab XENP20350, scFv XENP20387 vlCDR2
GASSRAT

SEQ ID NO: 29692 - protein, 9 aa, Artificial Sequence
  Description of Artificial Sequence: Synthetic peptide
  Fab XENP20350, scFv XENP20387 vlCDR3
QQYGSSPWT

SEQ ID NO: 29693 - protein, 246 aa, Artificial Sequence; identical to SEQ ID NO: 7424
  Description of Artificial Sequence: Synthetic polypeptide
  Fab XENP20350, scFv XENP20387 scFv

SEQ ID NO: 29694 - protein, 118 aa, Artificial Sequence; identical to SEQ ID NO: 7137
  Description of Artificial Sequence: Synthetic polypeptide
  VH of Fab XENP20351, scFv XENP20388

SEQ ID NO: 29695 - protein, 5 aa, Artificial Sequence
  Description of Artificial Sequence: Synthetic peptide
  Fab XENP20351, scFv XENP20388 vhCDR1
SYTMH

SEQ ID NO: 29696 - protein, 17 aa, Artificial Sequence
  Description of Artificial Sequence: Synthetic peptide
  Fab XENP20351, scFv XENP20388 vhCDR2
FISYDGNHKYYADSVKG

SEQ ID NO: 29697 - protein, 9 aa, Artificial Sequence
  Description of Artificial Sequence: Synthetic peptide
  Fab XENP20351, scFv XENP20388 vhCDR3
TGHLGPFDL

SEQ ID NO: 29698 - protein, 20 aa, Artificial Sequence
  Description of Artificial Sequence: Synthetic peptide
  Fab XENP20351, scFv XENP20388 scFv linker
GKPGSGKPGSGKPGSGKPGS

SEQ ID NO: 29699 - protein, 108 aa, Artificial Sequence; identical to SEQ ID NO: 7435
  Description of Artificial Sequence: Synthetic polypeptide
  VL of Fab XENP20351, scFv XENP20388

SEQ ID NO: 29700 - protein, 12 aa, Artificial Sequence
  Description of Artificial Sequence: Synthetic peptide
  Fab XENP20351, scFv XENP20388 vlCDR1
RASQSVSSSYLA

SEQ ID NO: 29701 - protein, 7 aa, Artificial Sequence
  Description of Artificial Sequence: Synthetic peptide
  Fab XENP20351, scFv XENP20388 vlCDR2
GAFSRAT

SEQ ID NO: 29702 - protein, 9 aa, Artificial Sequence
  Description of Artificial Sequence: Synthetic peptide
  Fab XENP20351, scFv XENP20388 vlCDR3
QQYGSSPWT

SEQ ID NO: 29703 - protein, 246 aa, Artificial Sequence; identical to SEQ ID NO: 7433
  Description of Artificial Sequence: Synthetic polypeptide
  Fab XENP20351, scFv XENP20388 scFv

SEQ ID NO: 29704 - protein, 20 aa, Artificial Sequence
  Description of Artificial Sequence: Synthetic peptide
  Fab XENP20352, scFv XENP20389 scFv linker
GKPGSGKPGSGKPGSGKPGS

SEQ ID NO: 29705 - protein, 118 aa, Artificial Sequence; identical to SEQ ID NO: 7137
  Description of Artificial Sequence: Synthetic polypeptide
  VL of Fab XENP20352, scFv XENP20389

SEQ ID NO: 29706 - protein, 5 aa, Artificial Sequence
  Description of Artificial Sequence: Synthetic peptide
  Fab XENP20352, scFv XENP20389 vlCDR1
SYTMH

SEQ ID NO: 29707 - protein, 17 aa, Artificial Sequence
  Description of Artificial Sequence: Synthetic peptide
  Fab XENP20352, scFv XENP20389 vlCDR2
FISYDGNHKYYADSVKG

SEQ ID NO: 29708 - protein, 9 aa, Artificial Sequence
  Description of Artificial Sequence: Synthetic peptide
  Fab XENP20352, scFv XENP20389 vlCDR3
TGHLGPFDL

SEQ ID NO: 29709 - protein, 246 aa, Artificial Sequence; identical to SEQ ID NO: 7442
  Description of Artificial Sequence: Synthetic polypeptide
  Fab XENP20352, scFv XENP20389 scFv

SEQ ID NO: 29710 - protein, 118 aa, Artificial Sequence; identical to SEQ ID NO: 7137
  Description of Artificial Sequence: Synthetic polypeptide
  VH of Fab XENP20353, scFv XENP20390

SEQ ID NO: 29711 - protein, 5 aa, Artificial Sequence
  Description of Artificial Sequence: Synthetic peptide
  Fab XENP20353, scFv XENP20390 vhCDR1
SYTMH

SEQ ID NO: 29712 - protein, 17 aa, Artificial Sequence
  Description of Artificial Sequence: Synthetic peptide
  Fab XENP20353, scFv XENP20390 vhCDR2
FISYDGNHKYYADSVKG

SEQ ID NO: 29713 - protein, 9 aa, Artificial Sequence
  Description of Artificial Sequence: Synthetic peptide
  Fab XENP20353, scFv XENP20390 vhCDR3
TGHLGPFDL

SEQ ID NO: 29714 - protein, 20 aa, Artificial Sequence
  Description of Artificial Sequence: Synthetic peptide
  Fab XENP20353, scFv XENP20390 scFv linker
GKPGSGKPGSGKPGSGKPGS

SEQ ID NO: 29715 - protein, 108 aa, Artificial Sequence; identical to SEQ ID NO: 7453
  Description of Artificial Sequence: Synthetic polypeptide
  VL of Fab XENP20353, scFv XENP20390

SEQ ID NO: 29716 - protein, 12 aa, Artificial Sequence
  Description of Artificial Sequence: Synthetic peptide
  Fab XENP20353, scFv XENP20390 vlCDR1
RASQSVSSSYLA

SEQ ID NO: 29717 - protein, 7 aa, Artificial Sequence
  Description of Artificial Sequence: Synthetic peptide
  Fab XENP20353, scFv XENP20390 vlCDR2
GASSRAT

SEQ ID NO: 29718 - protein, 9 aa, Artificial Sequence
  Description of Artificial Sequence: Synthetic peptide
  Fab XENP20353, scFv XENP20390 vlCDR3
QQYGSSPWT

SEQ ID NO: 29719 - protein, 246 aa, Artificial Sequence; identical to SEQ ID NO: 7451
  Description of Artificial Sequence: Synthetic polypeptide
  Fab XENP20353, scFv XENP20390 scFv

SEQ ID NO: 29720 - protein, 118 aa, Artificial Sequence; identical to SEQ ID NO: 7137
  Description of Artificial Sequence: Synthetic polypeptide
  VH of Fab XENP20354, scFv XENP20391

SEQ ID NO: 29721 - protein, 5 aa, Artificial Sequence
  Description of Artificial Sequence: Synthetic peptide
  Fab XENP20354, scFv XENP20391 vhCDR1
SYTMH

SEQ ID NO: 29722 - protein, 17 aa, Artificial Sequence
  Description of Artificial Sequence: Synthetic peptide
  Fab XENP20354, scFv XENP20391 vhCDR2
FISYDGNHKYYADSVKG

SEQ ID NO: 29723 - protein, 9 aa, Artificial Sequence
  Description of Artificial Sequence: Synthetic peptide
  Fab XENP20354, scFv XENP20391 vhCDR3
TGHLGPFDL

SEQ ID NO: 29724 - protein, 20 aa, Artificial Sequence
  Description of Artificial Sequence: Synthetic peptide
  Fab XENP20354, scFv XENP20391 scFv linker
GKPGSGKPGSGKPGSGKPGS

SEQ ID NO: 29725 - protein, 108 aa, Artificial Sequence; identical to SEQ ID NO: 7462
  Description of Artificial Sequence: Synthetic polypeptide
  VL of Fab XENP20354, scFv XENP20391

SEQ ID NO: 29726 - protein, 12 aa, Artificial Sequence
  Description of Artificial Sequence: Synthetic peptide
  Fab XENP20354, scFv XENP20391 vlCDR1
RASQSVSSSYLA

SEQ ID NO: 29727 - protein, 7 aa, Artificial Sequence
  Description of Artificial Sequence: Synthetic peptide
  Fab XENP20354, scFv XENP20391 vlCDR2
GASSRAT

SEQ ID NO: 29728 - protein, 9 aa, Artificial Sequence
  Description of Artificial Sequence: Synthetic peptide
  Fab XENP20354, scFv XENP20391 vlCDR3
QQYGSSPWT

SEQ ID NO: 29729 - protein, 246 aa, Artificial Sequence; identical to SEQ ID NO: 7460
  Description of Artificial Sequence: Synthetic polypeptide
  Fab XENP20354, scFv XENP20391 scFv

SEQ ID NO: 29730 - protein, 118 aa, Artificial Sequence; identical to SEQ ID NO: 7137
  Description of Artificial Sequence: Synthetic polypeptide
  VH of Fab XENP20355, scFv XENP20392

SEQ ID NO: 29731 - protein, 5 aa, Artificial Sequence
  Description of Artificial Sequence: Synthetic peptide
  Fab XENP20355, scFv XENP20392 vhCDR1
SYTMH

SEQ ID NO: 29732 - protein, 17 aa, Artificial Sequence
  Description of Artificial Sequence: Synthetic peptide
  Fab XENP20355, scFv XENP20392 vhCDR2
FISYDGNHKYYADSVKG

SEQ ID NO: 29733 - protein, 9 aa, Artificial Sequence
  Description of Artificial Sequence: Synthetic peptide
  Fab XENP20355, scFv XENP20392 vhCDR3
TGHLGPFDL

SEQ ID NO: 29734 - protein, 20 aa, Artificial Sequence
  Description of Artificial Sequence: Synthetic peptide
  Fab XENP20355, scFv XENP20392 scFv linker
GKPGSGKPGSGKPGSGKPGS

SEQ ID NO: 29735 - protein, 108 aa, Artificial Sequence; identical to SEQ ID NO: 7471
  Description of Artificial Sequence: Synthetic polypeptide
  VL of Fab XENP20355, scFv XENP20392

SEQ ID NO: 29736 - protein, 12 aa, Artificial Sequence
  Description of Artificial Sequence: Synthetic peptide
  Fab XENP20355, scFv XENP20392 vlCDR1
RASQSVSSSYLA

SEQ ID NO: 29737 - protein, 7 aa, Artificial Sequence
  Description of Artificial Sequence: Synthetic peptide
  Fab XENP20355, scFv XENP20392 vlCDR2
GASSRAT

SEQ ID NO: 29738 - protein, 9 aa, Artificial Sequence
  Description of Artificial Sequence: Synthetic peptide
  Fab XENP20355, scFv XENP20392 vlCDR3
QQYGSSPWT

SEQ ID NO: 29739 - protein, 246 aa, Artificial Sequence; identical to SEQ ID NO: 7469
  Description of Artificial Sequence: Synthetic polypeptide
  Fab XENP20355, scFv XENP20392 scFv

SEQ ID NO: 29740 - protein, 118 aa, Artificial Sequence; identical to SEQ ID NO: 7146
  Description of Artificial Sequence: Synthetic polypeptide
  VH of Fab XENP20357, scFv XENP20394

SEQ ID NO: 29741 - protein, 5 aa, Artificial Sequence
  Description of Artificial Sequence: Synthetic peptide
  Fab XENP20357, scFv XENP20394 vhCDR1
SYTMH

SEQ ID NO: 29742 - protein, 17 aa, Artificial Sequence
  Description of Artificial Sequence: Synthetic peptide
  Fab XENP20357, scFv XENP20394 vhCDR2
FISYDGNTKYYADSVKG

SEQ ID NO: 29743 - protein, 9 aa, Artificial Sequence
  Description of Artificial Sequence: Synthetic peptide
  Fab XENP20357, scFv XENP20394 vhCDR3
TGHLGPFDL

SEQ ID NO: 29744 - protein, 20 aa, Artificial Sequence
  Description of Artificial Sequence: Synthetic peptide
  Fab XENP20357, scFv XENP20394 scFv linker
GKPGSGKPGSGKPGSGKPGS

SEQ ID NO: 29745 - protein, 108 aa, Artificial Sequence; identical to SEQ ID NO: 7489
  Description of Artificial Sequence: Synthetic polypeptide
  VL of Fab XENP20357, scFv XENP20394

SEQ ID NO: 29746 - protein, 12 aa, Artificial Sequence
  Description of Artificial Sequence: Synthetic peptide
  Fab XENP20357, scFv XENP20394 vlCDR1
RASQSVSSSYLA

SEQ ID NO: 29747 - protein, 7 aa, Artificial Sequence
  Description of Artificial Sequence: Synthetic peptide
  Fab XENP20357, scFv XENP20394 vlCDR2
GAFSRAT

SEQ ID NO: 29748 - protein, 9 aa, Artificial Sequence
  Description of Artificial Sequence: Synthetic peptide
  Fab XENP20357, scFv XENP20394 vlCDR3
QQYGSSPWT

SEQ ID NO: 29749 - protein, 246 aa, Artificial Sequence; identical to SEQ ID NO: 7487
  Description of Artificial Sequence: Synthetic polypeptide
  Fab XENP20357, scFv XENP20394 scFv

SEQ ID NO: 29750 - protein, 118 aa, Artificial Sequence; identical to SEQ ID NO: 7146
  Description of Artificial Sequence: Synthetic polypeptide
  VH of Fab XENP20358, scFv XENP20395

SEQ ID NO: 29751 - protein, 5 aa, Artificial Sequence
  Description of Artificial Sequence: Synthetic peptide
  Fab XENP20358, scFv XENP20395 vhCDR1
SYTMH

SEQ ID NO: 29752 - protein, 17 aa, Artificial Sequence
  Description of Artificial Sequence: Synthetic peptide
  Fab XENP20358, scFv XENP20395 vhCDR2
FISYDGNTKYYADSVKG

SEQ ID NO: 29753 - protein, 9 aa, Artificial Sequence
  Description of Artificial Sequence: Synthetic peptide
  Fab XENP20358, scFv XENP20395 vhCDR3
TGHLGPFDL

SEQ ID NO: 29754 - protein, 20 aa, Artificial Sequence
  Description of Artificial Sequence: Synthetic peptide
  Fab XENP20358, scFv XENP20395 scFv linker
GKPGSGKPGSGKPGSGKPGS

SEQ ID NO: 29755 - protein, 108 aa, Artificial Sequence; identical to SEQ ID NO: 7498
  Description of Artificial Sequence: Synthetic polypeptide
  VL of Fab XENP20358, scFv XENP20395

SEQ ID NO: 29756 - protein, 12 aa, Artificial Sequence
  Description of Artificial Sequence: Synthetic peptide
  Fab XENP20358, scFv XENP20395 vlCDR1
RASQSVGSSYLA

SEQ ID NO: 29757 - protein, 7 aa, Artificial Sequence
  Description of Artificial Sequence: Synthetic peptide
  Fab XENP20358, scFv XENP20395 vlCDR2
GASSRAT

SEQ ID NO: 29758 - protein, 9 aa, Artificial Sequence
  Description of Artificial Sequence: Synthetic peptide
  Fab XENP20358, scFv XENP20395 vlCDR3
QQYGSSPWT

SEQ ID NO: 29759 - protein, 246 aa, Artificial Sequence; identical to SEQ ID NO: 7496
  Description of Artificial Sequence: Synthetic polypeptide
  Fab XENP20358, scFv XENP20395 scFv

SEQ ID NO: 29760 - protein, 118 aa, Artificial Sequence; identical to SEQ ID NO: 7146
  Description of Artificial Sequence: Synthetic polypeptide
  VH of Fab XENP20359, scFv XENP20396

SEQ ID NO: 29761 - protein, 5 aa, Artificial Sequence
  Description of Artificial Sequence: Synthetic peptide
  Fab XENP20359, scFv XENP20396 vhCDR1
SYTMH

SEQ ID NO: 29762 - protein, 17 aa, Artificial Sequence
  Description of Artificial Sequence: Synthetic peptide
  Fab XENP20359, scFv XENP20396 vhCDR2
FISYDGNTKYYADSVKG

SEQ ID NO: 29763 - protein, 9 aa, Artificial Sequence
  Description of Artificial Sequence: Synthetic peptide
  Fab XENP20359, scFv XENP20396 vhCDR3
TGHLGPFDL

SEQ ID NO: 29764 - protein, 20 aa, Artificial Sequence
  Description of Artificial Sequence: Synthetic peptide
  Fab XENP20359, scFv XENP20396 scFv linker
GKPGSGKPGSGKPGSGKPGS

SEQ ID NO: 29765 - protein, 108 aa, Artificial Sequence; identical to SEQ ID NO: 7507
  Description of Artificial Sequence: Synthetic polypeptide
  VL of Fab XENP20359, scFv XENP20396

SEQ ID NO: 29766 - protein, 12 aa, Artificial Sequence
  Description of Artificial Sequence: Synthetic peptide
  Fab XENP20359, scFv XENP20396 vlCDR1
RASQSVSSSYLA

SEQ ID NO: 29767 - protein, 7 aa, Artificial Sequence
  Description of Artificial Sequence: Synthetic peptide
  Fab XENP20359, scFv XENP20396 vlCDR2
GASSRAT

SEQ ID NO: 29768 - protein, 9 aa, Artificial Sequence
  Description of Artificial Sequence: Synthetic peptide
  Fab XENP20359, scFv XENP20396 vlCDR3
QQYGSSPWT

SEQ ID NO: 29769 - protein, 246 aa, Artificial Sequence; identical to SEQ ID NO: 7505
  Description of Artificial Sequence: Synthetic polypeptide
  Fab XENP20359, scFv XENP20396 scFv

SEQ ID NO: 29770 - protein, 118 aa, Artificial Sequence; identical to SEQ ID NO: 2405
  Description of Artificial Sequence: Synthetic polypeptide
  VH of Fab XENP19546, scFv XENP19553

SEQ ID NO: 29771 - protein, 5 aa, Artificial Sequence
  Description of Artificial Sequence: Synthetic peptide
  Fab XENP19546, scFv XENP19553 vhCDR1
SYTMH

SEQ ID NO: 29772 - protein, 17 aa, Artificial Sequence
  Description of Artificial Sequence: Synthetic peptide
  Fab XENP19546, scFv XENP19553 vhCDR2
FISYDGNNKYYADSVKG

SEQ ID NO: 29773 - protein, 9 aa, Artificial Sequence
  Description of Artificial Sequence: Synthetic peptide
  Fab XENP19546, scFv XENP19553 vhCDR3
TGWLGPFDY

SEQ ID NO: 29774 - protein, 20 aa, Artificial Sequence
  Description of Artificial Sequence: Synthetic peptide
  Fab XENP19546, scFv XENP19553 scFv linker
GKPGSGKPGSGKPGSGKPGS

SEQ ID NO: 29775 - protein, 108 aa, Artificial Sequence; identical to SEQ ID NO: 3741
  Description of Artificial Sequence: Synthetic polypeptide
  VL of Fab XENP19546, scFv XENP19553

SEQ ID NO: 29776 - protein, 12 aa, Artificial Sequence
  Description of Artificial Sequence: Synthetic peptide
  Fab XENP19546, scFv XENP19553 vlCDR1
RASQSVGSSYLA

SEQ ID NO: 29777 - protein, 7 aa, Artificial Sequence
  Description of Artificial Sequence: Synthetic peptide
  Fab XENP19546, scFv XENP19553 vlCDR2
GAFSRAT

SEQ ID NO: 29778 - protein, 9 aa, Artificial Sequence
  Description of Artificial Sequence: Synthetic peptide
  Fab XENP19546, scFv XENP19553 vlCDR3
QQYGSSPWT

SEQ ID NO: 29779 - protein, 246 aa, Artificial Sequence; identical to SEQ ID NO: 4814
  Description of Artificial Sequence: Synthetic polypeptide
  Fab XENP19546, scFv XENP19553 scFv

SEQ ID NO: 29780 - protein, 118 aa, Artificial Sequence; identical to SEQ ID NO: 2405
  Description of Artificial Sequence: Synthetic polypeptide
  VH of XENP20011

SEQ ID NO: 29781 - protein, 5 aa, Artificial Sequence
  Description of Artificial Sequence: Synthetic peptide
  XENP20011 vhCDR1
SYTMH

SEQ ID NO: 29782 - protein, 17 aa, Artificial Sequence
  Description of Artificial Sequence: Synthetic peptide
  XENP20011 vhCDR2
FISYDGNNKYYADSVKG

SEQ ID NO: 29783 - protein, 9 aa, Artificial Sequence
  Description of Artificial Sequence: Synthetic peptide
  XENP20011 vhCDR3
TGWLGPFDY

SEQ ID NO: 29784 - protein, 20 aa, Artificial Sequence
  Description of Artificial Sequence: Synthetic peptide
  XENP20011 scFv linker
GKPGSGKPGSGKPGSGKPGS

SEQ ID NO: 29785 - protein, 108 aa, Artificial Sequence; identical to SEQ ID NO: 2411
  Description of Artificial Sequence: Synthetic polypeptide
  VL of XENP20011

SEQ ID NO: 29786 - protein, 12 aa, Artificial Sequence
  Description of Artificial Sequence: Synthetic peptide
  XENP20011 vlCDR1
RASQSVSSSYLA

SEQ ID NO: 29787 - protein, 7 aa, Artificial Sequence
  Description of Artificial Sequence: Synthetic peptide
  XENP20011 vlCDR2
GAFSRAT

SEQ ID NO: 29788 - protein, 9 aa, Artificial Sequence
  Description of Artificial Sequence: Synthetic peptide
  XENP20011 vlCDR3
QQYGSSPWT

SEQ ID NO: 29789 - protein, 246 aa, Artificial Sequence
  Description of Artificial Sequence: Synthetic polypeptide
  XENP20011 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 29790 - protein, 118 aa, Artificial Sequence; identical to SEQ ID NO: 2405
  Description of Artificial Sequence: Synthetic polypeptide
  VH of XENP20052

SEQ ID NO: 29791 - protein, 5 aa, Artificial Sequence
  Description of Artificial Sequence: Synthetic peptide
  XENP20052 vhCDR1
SYTMH

SEQ ID NO: 29792 - protein, 17 aa, Artificial Sequence
  Description of Artificial Sequence: Synthetic peptide
  XENP20052 vhCDR2
FISYDGNNKYYADSVKG

SEQ ID NO: 29793 - protein, 9 aa, Artificial Sequence
  Description of Artificial Sequence: Synthetic peptide
  XENP20052 vhCDR3
TGWLGPFDY

SEQ ID NO: 29794 - protein, 20 aa, Artificial Sequence
  Description of Artificial Sequence: Synthetic peptide
  XENP20052 scFv linker
GKPGSGKPGSGKPGSGKPGS

SEQ ID NO: 29795 - protein, 108 aa, Artificial Sequence; identical to SEQ ID NO: 6481
  Description of Artificial Sequence: Synthetic polypeptide
  VL of XENP20052

SEQ ID NO: 29796 - protein, 12 aa, Artificial Sequence
  Description of Artificial Sequence: Synthetic peptide
  XENP20052 vlCDR1
RASQSVGSSYLS

SEQ ID NO: 29797 - protein, 7 aa, Artificial Sequence
  Description of Artificial Sequence: Synthetic peptide
  XENP20052 vlCDR2
GAFSRAT

SEQ ID NO: 29798 - protein, 9 aa, Artificial Sequence
  Description of Artificial Sequence: Synthetic peptide
  XENP20052 vlCDR3
QQYGSSPWT

SEQ ID NO: 29799 - protein, 246 aa, Artificial Sequence
  Description of Artificial Sequence: Synthetic polypeptide
  XENP20052 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 29800 - protein, 118 aa, Artificial Sequence; identical to SEQ ID NO: 2405
  Description of Artificial Sequence: Synthetic polypeptide
  VH of XENP20018

SEQ ID NO: 29801 - protein, 5 aa, Artificial Sequence
  Description of Artificial Sequence: Synthetic peptide
  XENP20018 vhCDR1
SYTMH

SEQ ID NO: 29802 - protein, 17 aa, Artificial Sequence
  Description of Artificial Sequence: Synthetic peptide
  XENP20018 vhCDR2
FISYDGNNKYYADSVKG

SEQ ID NO: 29803 - protein, 9 aa, Artificial Sequence
  Description of Artificial Sequence: Synthetic peptide
  XENP20018 vhCDR3
TGWLGPFDY

SEQ ID NO: 29804 - protein, 20 aa, Artificial Sequence
  Description of Artificial Sequence: Synthetic peptide
  XENP20018 scFv linker
GKPGSGKPGSGKPGSGKPGS

SEQ ID NO: 29805 - protein, 108 aa, Artificial Sequence; identical to SEQ ID NO: 6688
  Description of Artificial Sequence: Synthetic polypeptide
  VL of XENP20018

SEQ ID NO: 29806 - protein, 12 aa, Artificial Sequence
  Description of Artificial Sequence: Synthetic peptide
  XENP20018 vlCDR1
RASQSVGSSYLA

SEQ ID NO: 29807 - protein, 7 aa, Artificial Sequence
  Description of Artificial Sequence: Synthetic peptide
  XENP20018 vlCDR2
DAFSRAT

SEQ ID NO: 29808 - protein, 9 aa, Artificial Sequence
  Description of Artificial Sequence: Synthetic peptide
  XENP20018 vlCDR3
QQYGSSPWT

SEQ ID NO: 29809 - protein, 246 aa, Artificial Sequence
  Description of Artificial Sequence: Synthetic polypeptide
  XENP20018 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 29810 - protein, 118 aa, Artificial Sequence; identical to SEQ ID NO: 2405
  Description of Artificial Sequence: Synthetic polypeptide
  VH of XENP20020

SEQ ID NO: 29811 - protein, 5 aa, Artificial Sequence
  Description of Artificial Sequence: Synthetic peptide
  XENP20020 vhCDR1
SYTMH

SEQ ID NO: 29812 - protein, 17 aa, Artificial Sequence
  Description of Artificial Sequence: Synthetic peptide
  XENP20020 vhCDR2
FISYDGNNKYYADSVKG

SEQ ID NO: 29813 - protein, 9 aa, Artificial Sequence
  Description of Artificial Sequence: Synthetic peptide
  XENP20020 vhCDR3
TGWLGPFDY

SEQ ID NO: 29814 - protein, 20 aa, Artificial Sequence
  Description of Artificial Sequence: Synthetic peptide
  XENP20020 scFv linker
GKPGSGKPGSGKPGSGKPGS

SEQ ID NO: 29815 - protein, 108 aa, Artificial Sequence; identical to SEQ ID NO: 6751
  Description of Artificial Sequence: Synthetic polypeptide
  VL of XENP20020

SEQ ID NO: 29816 - protein, 12 aa, Artificial Sequence
  Description of Artificial Sequence: Synthetic peptide
  XENP20020 vlCDR1
RASQSVGSSYLA

SEQ ID NO: 29817 - protein, 7 aa, Artificial Sequence
  Description of Artificial Sequence: Synthetic peptide
  XENP20020 vlCDR2
GAYSRAT

SEQ ID NO: 29818 - protein, 9 aa, Artificial Sequence
  Description of Artificial Sequence: Synthetic peptide
  XENP20020 vlCDR3
QQYGSSPWT

SEQ ID NO: 29819 - protein, 246 aa, Artificial Sequence
  Description of Artificial Sequence: Synthetic polypeptide
  XENP20020 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 29820 - protein, 121 aa, Artificial Sequence; identical to SEQ ID NO: 2516
  Description of Artificial Sequence: Synthetic polypeptide
  VH of XENP22594

SEQ ID NO: 29821 - protein, 5 aa, Artificial Sequence
  Description of Artificial Sequence: Synthetic peptide
  XENP22594 vhCDR1
DAWMS

SEQ ID NO: 29822 - protein, 19 aa, Artificial Sequence
  Description of Artificial Sequence: Synthetic peptide
  XENP22594 vhCDR2
EISTKANNHATYYAESVKG

SEQ ID NO: 29823 - protein, 10 aa, Artificial Sequence
  Description of Artificial Sequence: Synthetic peptide
  XENP22594 vhCDR3
LATWDWYFDV

SEQ ID NO: 29824 - protein, 111 aa, Artificial Sequence; identical to SEQ ID NO: 2421
  Description of Artificial Sequence: Synthetic polypeptide
  VL of XENP22594

SEQ ID NO: 29825 - protein, 15 aa, Artificial Sequence
  Description of Artificial Sequence: Synthetic peptide
  XENP22594 vlCDR1
RASQSVDYDGDSYMN

SEQ ID NO: 29826 - protein, 7 aa, Artificial Sequence
  Description of Artificial Sequence: Synthetic peptide
  XENP22594 vlCDR2
AASELES

SEQ ID NO: 29827 - protein, 9 aa, Artificial Sequence
  Description of Artificial Sequence: Synthetic peptide
  XENP22594 vlCDR3
QQSNEDPFT

SEQ ID NO: 29828 - protein, 118 aa, Artificial Sequence; identical to SEQ ID NO: 2646
  Description of Artificial Sequence: Synthetic polypeptide
  VH of XENP22656

SEQ ID NO: 29829 - protein, 5 aa, Artificial Sequence
  Description of Artificial Sequence: Synthetic peptide
  XENP22656 vhCDR1
DYFMH

SEQ ID NO: 29830 - protein, 17 aa, Artificial Sequence
  Description of Artificial Sequence: Synthetic peptide
  XENP22656 vhCDR2
WIDPELGDTEYAPKFQG

SEQ ID NO: 29831 - protein, 9 aa, Artificial Sequence
  Description of Artificial Sequence: Synthetic peptide
  XENP22656 vhCDR3
RGVYQALDY

SEQ ID NO: 29832 - protein, 107 aa, Artificial Sequence; identical to SEQ ID NO: 2661
  Description of Artificial Sequence: Synthetic polypeptide
  VL of XENP22656

SEQ ID NO: 29833 - protein, 11 aa, Artificial Sequence
  Description of Artificial Sequence: Synthetic peptide
  XENP22656 vlCDR1
QASQDIGNYLN

SEQ ID NO: 29834 - protein, 7 aa, Artificial Sequence
  Description of Artificial Sequence: Synthetic peptide
  XENP22656 vlCDR2
FTSYLHS

SEQ ID NO: 29835 - protein, 9 aa, Artificial Sequence
  Description of Artificial Sequence: Synthetic peptide
  XENP22656 vlCDR3
QQGNTLPYT

SEQ ID NO: 29836 - protein, 121 aa, Artificial Sequence
  Description of Artificial Sequence: Synthetic polypeptide
  VH of XENP21670
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 29837 - protein, 5 aa, Artificial Sequence
  Description of Artificial Sequence: Synthetic peptide
  XENP21670 vhCDR1
DAWMD

SEQ ID NO: 29838 - protein, 19 aa, Artificial Sequence
  Description of Artificial Sequence: Synthetic peptide
  XENP21670 vhCDR2
EISTKANNHATYYAESVKG

SEQ ID NO: 29839 - protein, 10 aa, Artificial Sequence
  Description of Artificial Sequence: Synthetic peptide
  XENP21670 vhCDR3
LATWDWYFDV

SEQ ID NO: 29840 - protein, 111 aa, Artificial Sequence
  Description of Artificial Sequence: Synthetic polypeptide
  VL of XENP21670
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 29841 - protein, 15 aa, Artificial Sequence
  Description of Artificial Sequence: Synthetic peptide
  XENP21670 vlCDR1
RASQSVDYDGDSYMN

SEQ ID NO: 29842 - protein, 7 aa, Artificial Sequence
  Description of Artificial Sequence: Synthetic peptide
  XENP21670 vlCDR2
AASELES

SEQ ID NO: 29843 - protein, 9 aa, Artificial Sequence
  Description of Artificial Sequence: Synthetic peptide
  XENP21670 vlCDR3
QQSNEDPFT

SEQ ID NO: 29844 - protein, 121 aa, Artificial Sequence; identical to SEQ ID NO: 22262
  Description of Artificial Sequence: Synthetic polypeptide
  VH of XENP20930

SEQ ID NO: 29845 - protein, 5 aa, Artificial Sequence
  Description of Artificial Sequence: Synthetic peptide
  XENP20930 vhCDR1
DAWMD

SEQ ID NO: 29846 - protein, 19 aa, Artificial Sequence
  Description of Artificial Sequence: Synthetic peptide
  XENP20930 vhCDR2
EIRTKANNHATYYAESVKG

SEQ ID NO: 29847 - protein, 10 aa, Artificial Sequence
  Description of Artificial Sequence: Synthetic peptide
  XENP20930 vhCDR3
LANWDWYFDV

SEQ ID NO: 29848 - protein, 111 aa, Artificial Sequence; identical to SEQ ID NO: 22267
  Description of Artificial Sequence: Synthetic polypeptide
  VL of XENP20930

SEQ ID NO: 29849 - protein, 15 aa, Artificial Sequence
  Description of Artificial Sequence: Synthetic peptide
  XENP20930 vlCDR1
KASQSVDYDGDSYMN

SEQ ID NO: 29850 - protein, 7 aa, Artificial Sequence
  Description of Artificial Sequence: Synthetic peptide
  XENP20930 vlCDR2
AASNLES

SEQ ID NO: 29851 - protein, 9 aa, Artificial Sequence
  Description of Artificial Sequence: Synthetic peptide
  XENP20930 vlCDR3
QQSNEDPFT

SEQ ID NO: 29852 - protein, 118 aa, Artificial Sequence; identical to SEQ ID NO: 2706
  Description of Artificial Sequence: Synthetic polypeptide
  VH of XENP21921

SEQ ID NO: 29853 - protein, 5 aa, Artificial Sequence
  Description of Artificial Sequence: Synthetic peptide
  XENP21921 vhCDR1
HYFMH

SEQ ID NO: 29854 - protein, 17 aa, Artificial Sequence
  Description of Artificial Sequence: Synthetic peptide
  XENP21921 vhCDR2
WIDPYLGDTEYAPKFQG

SEQ ID NO: 29855 - protein, 9 aa, Artificial Sequence
  Description of Artificial Sequence: Synthetic peptide
  XENP21921 vhCDR3
RGVYQALDY

SEQ ID NO: 29856 - protein, 107 aa, Artificial Sequence; identical to SEQ ID NO: 2681
  Description of Artificial Sequence: Synthetic polypeptide
  VL of XENP21921

SEQ ID NO: 29857 - protein, 11 aa, Artificial Sequence
  Description of Artificial Sequence: Synthetic peptide
  XENP21921 vlCDR1
QASQDIGNYLN

SEQ ID NO: 29858 - protein, 7 aa, Artificial Sequence
  Description of Artificial Sequence: Synthetic peptide
  XENP21921 vlCDR2
FTSYLHS

SEQ ID NO: 29859 - protein, 9 aa, Artificial Sequence
  Description of Artificial Sequence: Synthetic peptide
  XENP21921 vlCDR3
QQGNTLPYT

SEQ ID NO: 29860 - protein, 118 aa, Artificial Sequence; identical to SEQ ID NO: 2686
  Description of Artificial Sequence: Synthetic polypeptide
  VH of XENP20847

SEQ ID NO: 29861 - protein, 5 aa, Artificial Sequence
  Description of Artificial Sequence: Synthetic peptide
  XENP20847 vhCDR1
DYYMH

SEQ ID NO: 29862 - protein, 17 aa, Artificial Sequence
  Description of Artificial Sequence: Synthetic peptide
  XENP20847 vhCDR2
WIDPENGDTEYAPKFQG

SEQ ID NO: 29863 - protein, 9 aa, Artificial Sequence
  Description of Artificial Sequence: Synthetic peptide
  XENP20847 vhCDR3
RGVRQALDY

SEQ ID NO: 29864 - protein, 107 aa, Artificial Sequence; identical to SEQ ID NO: 2881
  Description of Artificial Sequence: Synthetic polypeptide
  VL of XENP20847

SEQ ID NO: 29865 - protein, 11 aa, Artificial Sequence
  Description of Artificial Sequence: Synthetic peptide
  XENP20847 vlCDR1
QASQDIGNYLN

SEQ ID NO: 29866 - protein, 7 aa, Artificial Sequence
  Description of Artificial Sequence: Synthetic peptide
  XENP20847 vlCDR2
YTSRLHS

SEQ ID NO: 29867 - protein, 9 aa, Artificial Sequence
  Description of Artificial Sequence: Synthetic peptide
  XENP20847 vlCDR3
QQGNTLPYT

SEQ ID NO: 29868 - protein, 118 aa, Artificial Sequence; identical to SEQ ID NO: 2686
  Description of Artificial Sequence: Synthetic polypeptide
  VH of XENP21372

SEQ ID NO: 29869 - protein, 5 aa, Artificial Sequence
  Description of Artificial Sequence: Synthetic peptide
  XENP21372 vhCDR1
DYYMH

SEQ ID NO: 29870 - protein, 17 aa, Artificial Sequence
  Description of Artificial Sequence: Synthetic peptide
  XENP21372 vhCDR2
WIDPENGDTEYAPKFQG

SEQ ID NO: 29871 - protein, 9 aa, Artificial Sequence
  Description of Artificial Sequence: Synthetic peptide
  XENP21372 vhCDR3
RGVRQALDY

SEQ ID NO: 29872 - protein, 107 aa, Artificial Sequence
  Description of Artificial Sequence: Synthetic polypeptide
  VL of XENP21372
DIQMTQSPAFLSVTPGEKVTITCQASQDIGNHLNWFQQKPDQTVKLLIYYTSRLHSGVPSRFSGSGSGTDYTFTISSLEAEDAATYFCQQGNTLPYTFGGGTKVEIK

SEQ ID NO: 29873 - protein, 11 aa, Artificial Sequence
  Description of Artificial Sequence: Synthetic peptide
  XENP21372 vlCDR1
QASQDIGNHLN

SEQ ID NO: 29874 - protein, 7 aa, Artificial Sequence
  Description of Artificial Sequence: Synthetic peptide
  XENP21372 vlCDR2
YTSRLHS

SEQ ID NO: 29875 - protein, 9 aa, Artificial Sequence
  Description of Artificial Sequence: Synthetic peptide
  XENP21372 vlCDR3
QQGNTLPYT

SEQ ID NO: 29876 - protein, 118 aa, Artificial Sequence; identical to SEQ ID NO: 2686
  Description of Artificial Sequence: Synthetic polypeptide
  VH of XENP21394

SEQ ID NO: 29877 - protein, 5 aa, Artificial Sequence
  Description of Artificial Sequence: Synthetic peptide
  XENP21394 vhCDR1
DYYMH

SEQ ID NO: 29878 - protein, 17 aa, Artificial Sequence
  Description of Artificial Sequence: Synthetic peptide
  XENP21394 vhCDR2
WIDPENGDTEYAPKFQG

SEQ ID NO: 29879 - protein, 9 aa, Artificial Sequence
  Description of Artificial Sequence: Synthetic peptide
  XENP21394 vhCDR3
RGVRQALDY

SEQ ID NO: 29880 - protein, 107 aa, Artificial Sequence
  Description of Artificial Sequence: Synthetic polypeptide
  VL of XENP21394
DIQMTQSPAFLSVTPGEKVTITCQASQDIGNYLNWFQQKPDQTVKLLIYYTSHLHSGVPSRFSGSGSGTDYTFTISSLEAEDAATYFCQQGNTLPYTFGGGTKVEIK

SEQ ID NO: 29881 - protein, 11 aa, Artificial Sequence
  Description of Artificial Sequence: Synthetic peptide
  XENP21394 vlCDR1
QASQDIGNYLN

SEQ ID NO: 29882 - protein, 7 aa, Artificial Sequence
  Description of Artificial Sequence: Synthetic peptide
  XENP21394 vlCDR2
YTSHLHS

SEQ ID NO: 29883 - protein, 9 aa, Artificial Sequence
  Description of Artificial Sequence: Synthetic peptide
  XENP21394 vlCDR3
QQGNTLPYT

SEQ ID NO: 29884 - protein, 118 aa, Artificial Sequence; identical to SEQ ID NO: 2686
  Description of Artificial Sequence: Synthetic polypeptide
  VH of XENP21401

SEQ ID NO: 29885 - protein, 5 aa, Artificial Sequence
  Description of Artificial Sequence: Synthetic peptide
  XENP21401 vhCDR1
DYYMH

SEQ ID NO: 29886 - protein, 17 aa, Artificial Sequence
  Description of Artificial Sequence: Synthetic peptide
  XENP21401 vhCDR2
WIDPENGDTEYAPKFQG

SEQ ID NO: 29887 - protein, 9 aa, Artificial Sequence
  Description of Artificial Sequence: Synthetic peptide
  XENP21401 vhCDR3
RGVRQALDY

SEQ ID NO: 29888 - protein, 107 aa, Artificial Sequence; identical to SEQ ID NO: 2901
  Description of Artificial Sequence: Synthetic polypeptide
  VL of XENP21401

SEQ ID NO: 29889 - protein, 11 aa, Artificial Sequence
  Description of Artificial Sequence: Synthetic peptide
  XENP21401 vlCDR1
QASQDIGNYLN

SEQ ID NO: 29890 - protein, 7 aa, Artificial Sequence
  Description of Artificial Sequence: Synthetic peptide
  XENP21401 vlCDR2
YTSYLHS

SEQ ID NO: 29891 - protein, 9 aa, Artificial Sequence
  Description of Artificial Sequence: Synthetic peptide
  XENP21401 vlCDR3
QQGNTLPYT

SEQ ID NO: 29892 - protein, 118 aa, Artificial Sequence; identical to SEQ ID NO: 2686
  Description of Artificial Sequence: Synthetic polypeptide
  VH of XENP20847

SEQ ID NO: 29893 - protein, 5 aa, Artificial Sequence
  Description of Artificial Sequence: Synthetic peptide
  XENP20847 vhCDR1
DYYMH

SEQ ID NO: 29894 - protein, 17 aa, Artificial Sequence
  Description of Artificial Sequence: Synthetic peptide
  XENP20847 vhCDR2
WIDPENGDTEYAPKFQG

SEQ ID NO: 29895 - protein, 9 aa, Artificial Sequence
  Description of Artificial Sequence: Synthetic peptide
  XENP20847 vhCDR3
RGVRQALDY

SEQ ID NO: 29896 - protein, 107 aa, Artificial Sequence; identical to SEQ ID NO: 2881
  Description of Artificial Sequence: Synthetic polypeptide
  VL of XENP20847

SEQ ID NO: 29897 - protein, 11 aa, Artificial Sequence
  Description of Artificial Sequence: Synthetic peptide
  XENP20847 vlCDR1
QASQDIGNYLN

SEQ ID NO: 29898 - protein, 7 aa, Artificial Sequence
  Description of Artificial Sequence: Synthetic peptide
  XENP20847 vlCDR2
YTSRLHS

SEQ ID NO: 29899 - protein, 9 aa, Artificial Sequence
  Description of Artificial Sequence: Synthetic peptide
  XENP20847 vlCDR3
QQGNTLPYT

SEQ ID NO: 29900 - protein, 121 aa, Artificial Sequence; identical to SEQ ID NO: 29836
  Description of Artificial Sequence: Synthetic polypeptide
  VH of XENP21670

SEQ ID NO: 29901 - protein, 5 aa, Artificial Sequence
  Description of Artificial Sequence: Synthetic peptide
  XENP21670 vhCDR1
DAWMD

SEQ ID NO: 29902 - protein, 19 aa, Artificial Sequence
  Description of Artificial Sequence: Synthetic peptide
  XENP21670 vhCDR2
EISTKANNHATYYAESVKG

SEQ ID NO: 29903 - protein, 10 aa, Artificial Sequence
  Description of Artificial Sequence: Synthetic peptide
  XENP21670 vhCDR3
LATWDWYFDV

SEQ ID NO: 29904 - protein, 111 aa, Artificial Sequence; identical to SEQ ID NO: 29840
  Description of Artificial Sequence: Synthetic polypeptide
  VL of XENP21670

SEQ ID NO: 29905 - protein, 15 aa, Artificial Sequence
  Description of Artificial Sequence: Synthetic peptide
  XENP21670 vlCDR1
RASQSVDYDGDSYMN

SEQ ID NO: 29906 - protein, 7 aa, Artificial Sequence
  Description of Artificial Sequence: Synthetic peptide
  XENP21670 vlCDR2
AASELES

SEQ ID NO: 29907 - protein, 9 aa, Artificial Sequence
  Description of Artificial Sequence: Synthetic peptide
  XENP21670 vlCDR3
QQSNEDPFT

SEQ ID NO: 29908 - protein, 121 aa, Artificial Sequence
  Description of Artificial Sequence: Synthetic polypeptide
  VH of XENP21892
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 29909 - protein, 5 aa, Artificial Sequence
  Description of Artificial Sequence: Synthetic peptide
  XENP21892 vhCDR1
DAWMD

SEQ ID NO: 29910 - protein, 19 aa, Artificial Sequence
  Description of Artificial Sequence: Synthetic peptide
  XENP21892 vhCDR2
EISTKAYNHATYYAESVKG

SEQ ID NO: 29911 - protein, 10 aa, Artificial Sequence
  Description of Artificial Sequence: Synthetic peptide
  XENP21892 vhCDR3
LATWDWYFDV

SEQ ID NO: 29912 - protein, 111 aa, Artificial Sequence; identical to SEQ ID NO: 22277
  Description of Artificial Sequence: Synthetic polypeptide
  VL of XENP21892

SEQ ID NO: 29913 - protein, 15 aa, Artificial Sequence
  Description of Artificial Sequence: Synthetic peptide
  XENP21892 vlCDR1
RASQSVDYDGDSYMN

SEQ ID NO: 29914 - protein, 7 aa, Artificial Sequence
  Description of Artificial Sequence: Synthetic peptide
  XENP21892 vlCDR2
AASNLES

SEQ ID NO: 29915 - protein, 9 aa, Artificial Sequence
  Description of Artificial Sequence: Synthetic peptide
  XENP21892 vlCDR3
QQSNEDPFT

SEQ ID NO: 29916 - protein, 121 aa, Artificial Sequence; identical to SEQ ID NO: 29908
  Description of Artificial Sequence: Synthetic polypeptide
  VH of XENP21893

SEQ ID NO: 29917 - protein, 5 aa, Artificial Sequence
  Description of Artificial Sequence: Synthetic peptide
  XENP21893 vhCDR1
DAWMD

SEQ ID NO: 29918 - protein, 19 aa, Artificial Sequence
  Description of Artificial Sequence: Synthetic peptide
  XENP21893 vhCDR2
EISTKAYNHATYYAESVKG

SEQ ID NO: 29919 - protein, 10 aa, Artificial Sequence
  Description of Artificial Sequence: Synthetic peptide
  XENP21893 vhCDR3
LATWDWYFDV

SEQ ID NO: 29920 - protein, 111 aa, Artificial Sequence; identical to SEQ ID NO: 29840
  Description of Artificial Sequence: Synthetic polypeptide
  VL of XENP21893

SEQ ID NO: 29921 - protein, 15 aa, Artificial Sequence
  Description of Artificial Sequence: Synthetic peptide
  XENP21893 vlCDR1
RASQSVDYDGDSYMN

SEQ ID NO: 29922 - protein, 7 aa, Artificial Sequence
  Description of Artificial Sequence: Synthetic peptide
  XENP21893 vlCDR2
AASELES

SEQ ID NO: 29923 - protein, 9 aa, Artificial Sequence
  Description of Artificial Sequence: Synthetic peptide
  XENP21893 vlCDR3
QQSNEDPFT

SEQ ID NO: 29924 - protein, 121 aa, Artificial Sequence; identical to SEQ ID NO: 29908
  Description of Artificial Sequence: Synthetic polypeptide
  VH of XENP21894

SEQ ID NO: 29925 - protein, 5 aa, Artificial Sequence
  Description of Artificial Sequence: Synthetic peptide
  XENP21894 vhCDR1
DAWMD

SEQ ID NO: 29926 - protein, 19 aa, Artificial Sequence
  Description of Artificial Sequence: Synthetic peptide
  XENP21894 vhCDR2
EISTKAYNHATYYAESVKG

SEQ ID NO: 29927 - protein, 10 aa, Artificial Sequence
  Description of Artificial Sequence: Synthetic peptide
  XENP21894 vhCDR3
LATWDWYFDV

SEQ ID NO: 29928 - protein, 111 aa, Artificial Sequence
  Description of Artificial Sequence: Synthetic polypeptide
  VL of XENP21894
DTVLTQSPSSLSASVGDRVTITCRASQSVDHDGDSYMNWYQQKPGKPPKLLIYAASELESGIPARLSGSGSGTDFTLTISSLQPEDFATYYCQQSNEDPFTFGSGTKLEIK

SEQ ID NO: 29929 - protein, 15 aa, Artificial Sequence
  Description of Artificial Sequence: Synthetic peptide
  XENP21894 vlCDR1
RASQSVDHDGDSYMN

SEQ ID NO: 29930 - protein, 7 aa, Artificial Sequence
  Description of Artificial Sequence: Synthetic peptide
  XENP21894 vlCDR2
AASELES

SEQ ID NO: 29931 - protein, 9 aa, Artificial Sequence
  Description of Artificial Sequence: Synthetic peptide
  XENP21894 vlCDR3
QQSNEDPFT

SEQ ID NO: 29932 - protein, 113 aa, Artificial Sequence; identical to SEQ ID NO: 3626
  Description of Artificial Sequence: Synthetic polypeptide
  VH of XENP21503

SEQ ID NO: 29933 - protein, 4 aa, Artificial Sequence
  Description of Artificial Sequence: Synthetic peptide
  XENP21503 vhCDR1
SFDM

SEQ ID NO: 29934 - protein, 17 aa, Artificial Sequence
  Description of Artificial Sequence: Synthetic peptide
  XENP21503 vhCDR2
YISSDGASTFYPDTMKG

SEQ ID NO: 29935 - protein, 4 aa, Artificial Sequence
  Description of Artificial Sequence: Synthetic peptide
  XENP21503 vhCDR3
LGAY

SEQ ID NO: 29936 - protein, 112 aa, Artificial Sequence; identical to SEQ ID NO: 3701
  Description of Artificial Sequence: Synthetic polypeptide
  VL of XENP21503

SEQ ID NO: 29937 - protein, 16 aa, Artificial Sequence
  Description of Artificial Sequence: Synthetic peptide
  XENP21503 vlCDR1
KSSQSLLDSDGKTYLN

SEQ ID NO: 29938 - protein, 6 aa, Artificial Sequence
  Description of Artificial Sequence: Synthetic peptide
  XENP21503 vlCDR2
VSKLDS

SEQ ID NO: 29939 - protein, 9 aa, Artificial Sequence
  Description of Artificial Sequence: Synthetic peptide
  XENP21503 vlCDR3
WQGTHFPYT

SEQ ID NO: 29940 - protein, 113 aa, Artificial Sequence; identical to SEQ ID NO: 3626
  Description of Artificial Sequence: Synthetic polypeptide
  VH of XENP21492

SEQ ID NO: 29941 - protein, 5 aa, Artificial Sequence
  Description of Artificial Sequence: Synthetic peptide
  XENP21492 vhCDR1
SFDMS

SEQ ID NO: 29942 - protein, 17 aa, Artificial Sequence
  Description of Artificial Sequence: Synthetic peptide
  XENP21492 vhCDR2
YISSDGASTFYPDTMKG

SEQ ID NO: 29943 - protein, 4 aa, Artificial Sequence
  Description of Artificial Sequence: Synthetic peptide
  XENP21492 vhCDR3
LGAY

SEQ ID NO: 29944 - protein, 111 aa, Artificial Sequence; identical to SEQ ID NO: 3631
  Description of Artificial Sequence: Synthetic polypeptide
  VL of XENP21492

SEQ ID NO: 29945 - protein, 14 aa, Artificial Sequence
  Description of Artificial Sequence: Synthetic peptide
  XENP21492 vlCDR1
RASESVEYYGTSLQ

SEQ ID NO: 29946 - protein, 7 aa, Artificial Sequence
  Description of Artificial Sequence: Synthetic peptide
  XENP21492 vlCDR2
AASNVES

SEQ ID NO: 29947 - protein, 9 aa, Artificial Sequence
  Description of Artificial Sequence: Synthetic peptide
  XENP21492 vlCDR3
QQSRKVPWT

SEQ ID NO: 29948 - protein, 117 aa, Artificial Sequence; identical to SEQ ID NO: 3366
  Description of Artificial Sequence: Synthetic polypeptide
  VH of XENP21189

SEQ ID NO: 29949 - protein, 5 aa, Artificial Sequence
  Description of Artificial Sequence: Synthetic peptide
  XENP21189 vhCDR1
GYGVN

SEQ ID NO: 29950 - protein, 16 aa, Artificial Sequence
  Description of Artificial Sequence: Synthetic peptide
  XENP21189 vhCDR2
MIWGDGSTDYNSALKS

SEQ ID NO: 29951 - protein, 9 aa, Artificial Sequence
  Description of Artificial Sequence: Synthetic peptide
  XENP21189 vhCDR3
SYYTSDEDY

SEQ ID NO: 29952 - protein, 112 aa, Artificial Sequence; identical to SEQ ID NO: 3511
  Description of Artificial Sequence: Synthetic polypeptide
  VL of XENP21189

SEQ ID NO: 29953 - protein, 17 aa, Artificial Sequence
  Description of Artificial Sequence: Synthetic peptide
  XENP21189 vlCDR1
KSSQSLLNSRTRKNYLA

SEQ ID NO: 29954 - protein, 7 aa, Artificial Sequence
  Description of Artificial Sequence: Synthetic peptide
  XENP21189 vlCDR2
WASTRES

SEQ ID NO: 29955 - protein, 8 aa, Artificial Sequence
  Description of Artificial Sequence: Synthetic peptide
  XENP21189 vlCDR3
KQSYSLRT

SEQ ID NO: 29956 - protein, 117 aa, Artificial Sequence; identical to SEQ ID NO: 3636
  Description of Artificial Sequence: Synthetic polypeptide
  VH of XENP21493

SEQ ID NO: 29957 - protein, 5 aa, Artificial Sequence
  Description of Artificial Sequence: Synthetic peptide
  XENP21493 vhCDR1
GYGVN

SEQ ID NO: 29958 - protein, 16 aa, Artificial Sequence
  Description of Artificial Sequence: Synthetic peptide
  XENP21493 vhCDR2
MIWGDGSTDYNSALKS

SEQ ID NO: 29959 - protein, 9 aa, Artificial Sequence
  Description of Artificial Sequence: Synthetic peptide
  XENP21493 vhCDR3
SYYTSDEDY

SEQ ID NO: 29960 - protein, 107 aa, Artificial Sequence; identical to SEQ ID NO: 3641
  Description of Artificial Sequence: Synthetic polypeptide
  VL of XENP21493

SEQ ID NO: 29961 - protein, 11 aa, Artificial Sequence
  Description of Artificial Sequence: Synthetic peptide
  XENP21493 vlCDR1
KASQNVGSNVA

SEQ ID NO: 29962 - protein, 7 aa, Artificial Sequence
  Description of Artificial Sequence: Synthetic peptide
  XENP21493 vlCDR2
SASFRYS

SEQ ID NO: 29963 - protein, 9 aa, Artificial Sequence
  Description of Artificial Sequence: Synthetic peptide
  XENP21493 vlCDR3
QQYNSYPYT

SEQ ID NO: 29964 - protein, 117 aa, Artificial Sequence; identical to SEQ ID NO: 3646
  Description of Artificial Sequence: Synthetic polypeptide
  VH of XENP21494

SEQ ID NO: 29965 - protein, 5 aa, Artificial Sequence
  Description of Artificial Sequence: Synthetic peptide
  XENP21494 vhCDR1
SYGVH

SEQ ID NO: 29966 - protein, 16 aa, Artificial Sequence
  Description of Artificial Sequence: Synthetic peptide
  XENP21494 vhCDR2
VIWSGGSTEYNAAFIS

SEQ ID NO: 29967 - protein, 9 aa, Artificial Sequence
  Description of Artificial Sequence: Synthetic peptide
  XENP21494 vhCDR3
GGLLSPFDY

SEQ ID NO: 29968 - protein, 111 aa, Artificial Sequence; identical to SEQ ID NO: 3631
  Description of Artificial Sequence: Synthetic polypeptide
  VL of XENP21494

SEQ ID NO: 29969 - protein, 15 aa, Artificial Sequence
  Description of Artificial Sequence: Synthetic peptide
  XENP21494 vlCDR1
RASESVEYYGTSLMQ

SEQ ID NO: 29970 - protein, 7 aa, Artificial Sequence
  Description of Artificial Sequence: Synthetic peptide
  XENP21494 vlCDR2
AASNVES

SEQ ID NO: 29971 - protein, 9 aa, Artificial Sequence
  Description of Artificial Sequence: Synthetic peptide
  XENP21494 vlCDR3
QQSRKVPWT

SEQ ID NO: 29972 - protein, 123 aa, Artificial Sequence; identical to SEQ ID NO: 3656
  Description of Artificial Sequence: Synthetic polypeptide
  VH of XENP21495

SEQ ID NO: 29973 - protein, 5 aa, Artificial Sequence
  Description of Artificial Sequence: Synthetic peptide
  XENP21495 vhCDR1
RYWMS

SEQ ID NO: 29974 - protein, 17 aa, Artificial Sequence
  Description of Artificial Sequence: Synthetic peptide
  XENP21495 vhCDR2
EINPDSSTINYTPSLKD

SEQ ID NO: 29975 - protein, 14 aa, Artificial Sequence
  Description of Artificial Sequence: Synthetic peptide
  XENP21495 vhCDR3
PNGYYVGTIFPFAY

SEQ ID NO: 29976 - protein, 110 aa, Artificial Sequence
  Description of Artificial Sequence: Synthetic polypeptide
  VL of XENP21495
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 29977 - protein, 14 aa, Artificial Sequence
  Description of Artificial Sequence: Synthetic peptide
  XENP21495 vlCDR1
RSSTGAVTTSNYAN

SEQ ID NO: 29978 - protein, 7 aa, Artificial Sequence
  Description of Artificial Sequence: Synthetic peptide
  XENP21495 vlCDR2
GTNNRAP

SEQ ID NO: 29979 - protein, 9 aa, Artificial Sequence
  Description of Artificial Sequence: Synthetic peptide
  XENP21495 vlCDR3
ALWYSNHWV

SEQ ID NO: 29980 - protein, 118 aa, Artificial Sequence; identical to SEQ ID NO: 3666
  Description of Artificial Sequence: Synthetic polypeptide
  VH of XENP21496

SEQ ID NO: 29981 - protein, 5 aa, Artificial Sequence
  Description of Artificial Sequence: Synthetic peptide
  XENP21496 vhCDR1
SYAVN

SEQ ID NO: 29982 - protein, 16 aa, Artificial Sequence
  Description of Artificial Sequence: Synthetic peptide
  XENP21496 vhCDR2
VIWSGGSTDYNAAFIS

SEQ ID NO: 29983 - protein, 10 aa, Artificial Sequence
  Description of Artificial Sequence: Synthetic peptide
  XENP21496 vhCDR3
LYYRYDGFDY

SEQ ID NO: 29984 - protein, 107 aa, Artificial Sequence; identical to SEQ ID NO: 25517
  Description of Artificial Sequence: Synthetic polypeptide
  VL of XENP21496

SEQ ID NO: 29985 - protein, 11 aa, Artificial Sequence
  Description of Artificial Sequence: Synthetic peptide
  XENP21496 vlCDR1
KASQNVGTHVA

SEQ ID NO: 29986 - protein, 7 aa, Artificial Sequence
  Description of Artificial Sequence: Synthetic peptide
  XENP21496 vlCDR2
SASYRYS

SEQ ID NO: 29987 - protein, 9 aa, Artificial Sequence
  Description of Artificial Sequence: Synthetic peptide
  XENP21496 vlCDR3
QQYNSYPLT

SEQ ID NO: 29988 - protein, 118 aa, Artificial Sequence; identical to SEQ ID NO: 3676
  Description of Artificial Sequence: Synthetic polypeptide
  VH of XENP21501

SEQ ID NO: 29989 - protein, 5 aa, Artificial Sequence
  Description of Artificial Sequence: Synthetic peptide
  XENP21501 vhCDR1
SYAVN

SEQ ID NO: 29990 - protein, 16 aa, Artificial Sequence
  Description of Artificial Sequence: Synthetic peptide
  XENP21501 vhCDR2
VIWSGGSTDYNAAFIS

SEQ ID NO: 29991 - protein, 10 aa, Artificial Sequence
  Description of Artificial Sequence: Synthetic peptide
  XENP21501 vhCDR3
LYYRYDGFDY

SEQ ID NO: 29992 - protein, 107 aa, Artificial Sequence; identical to SEQ ID NO: 25517
  Description of Artificial Sequence: Synthetic polypeptide
  VL of XENP21501

SEQ ID NO: 29993 - protein, 11 aa, Artificial Sequence
  Description of Artificial Sequence: Synthetic peptide
  XENP21501 vlCDR1
KASQNVGTHVA

SEQ ID NO: 29994 - protein, 7 aa, Artificial Sequence
  Description of Artificial Sequence: Synthetic peptide
  XENP21501 vlCDR2
SASYRYS

SEQ ID NO: 29995 - protein, 9 aa, Artificial Sequence
  Description of Artificial Sequence: Synthetic peptide
  XENP21501 vlCDR3
QQYNSYPLT

SEQ ID NO: 29996 - protein, 117 aa, Artificial Sequence; identical to SEQ ID NO: 3686
  Description of Artificial Sequence: Synthetic polypeptide
  VH of XENP21502

SEQ ID NO: 29997 - protein, 5 aa, Artificial Sequence
  Description of Artificial Sequence: Synthetic peptide
  XENP21502 vhCDR1
RYAMS

SEQ ID NO: 29998 - protein, 16 aa, Artificial Sequence
  Description of Artificial Sequence: Synthetic peptide
  XENP21502 vhCDR2
SISSGGSTYYPDSVQG

SEQ ID NO: 29999 - protein, 9 aa, Artificial Sequence
  Description of Artificial Sequence: Synthetic peptide
  XENP21502 vhCDR3
GDYEGYFDY

SEQ ID NO: 30000 - protein, 113 aa, Artificial Sequence; identical to SEQ ID NO: 3691
  Description of Artificial Sequence: Synthetic polypeptide
  VL of XENP21502

SEQ ID NO: 30001 - protein, 17 aa, Artificial Sequence
  Description of Artificial Sequence: Synthetic peptide
  XENP21502 vlCDR1
KSSQSLLNSINQKNYLA

SEQ ID NO: 30002 - protein, 7 aa, Artificial Sequence
  Description of Artificial Sequence: Synthetic peptide
  XENP21502 vlCDR2
FASTRES

SEQ ID NO: 30003 - protein, 9 aa, Artificial Sequence
  Description of Artificial Sequence: Synthetic peptide
  XENP21502 vlCDR3
QQHYSTPLT
